United States Patent
Wei et al.

(10) Patent No.: US 9,676,824 B2
(45) Date of Patent: Jun. 13, 2017

(54) HERPES SIMPLEX VIRUS VACCINE

(71) Applicant: GenVec, Inc., Gaithersburg, MD (US)

(72) Inventors: Lisa Wei, Gaithersburg, MD (US); Douglas E. Brough, Gaithersburg, MD (US); Christopher Lazarski, Germantown, MD (US)

(73) Assignee: GenVec, Inc., Gaithersburg, MD (US)

( * ) Notice: Subject to any disclaimer, the term of this patent is extended or adjusted under 35 U.S.C. 154(b) by 0 days.

(21) Appl. No.: 14/403,397

(22) PCT Filed: May 16, 2013

(86) PCT No.: PCT/US2013/041358
§ 371 (c)(1),
(2) Date: Nov. 24, 2014

(87) PCT Pub. No.: WO2013/180967
PCT Pub. Date: Dec. 5, 2013

(65) Prior Publication Data
US 2015/0140025 A1     May 21, 2015

Related U.S. Application Data

(60) Provisional application No. 61/760,426, filed on Feb. 4, 2013, provisional application No. 61/652,404, filed on May 29, 2012.

(51) Int. Cl.
| | | |
|---|---|---|
| C07K 14/005 | (2006.01) | |
| A61K 39/12 | (2006.01) | |
| C12N 7/00 | (2006.01) | |
| A61K 39/245 | (2006.01) | |
| A61K 39/00 | (2006.01) | |

(52) U.S. Cl.
CPC ............ *C07K 14/005* (2013.01); *A61K 39/12* (2013.01); *A61K 39/245* (2013.01); *C12N 7/00* (2013.01); *A61K 2039/53* (2013.01); *A61K 2039/545* (2013.01); *C12N 2710/10043* (2013.01); *C12N 2710/16622* (2013.01); *C12N 2710/16634* (2013.01); *C12N 2799/022* (2013.01); *C12N 2800/22* (2013.01)

(58) Field of Classification Search
CPC C07K 14/005; C07K 14/035; C07K 2319/20; A61K 39/12; A61K 39/245; A61K 2039/53; A61K 35/763; A61K 2039/525; A61K 2039/523; C12N 7/00; C12N 15/86; C12N 2710/24143; C12N 2710/16022; C12N 2710/10322; C12N 15/8695; C12N 2710/16122
See application file for complete search history.

(56) References Cited

U.S. PATENT DOCUMENTS

| | | | |
|---|---|---|---|
| 5,837,511 A | 11/1998 | Falck-Pedersen et al. | |
| 5,851,806 A | 12/1998 | Kovesdi et al. | |
| 5,994,106 A | 11/1999 | Kovesdi et al. | |
| 5,994,128 A | 11/1999 | Fallaux et al. | |
| 5,998,205 A | 12/1999 | Hallenbeck et al. | |
| 6,033,908 A | 3/2000 | Bout et al. | |
| 6,127,175 A | 10/2000 | Vigne et al. | |
| 6,225,289 B1 | 5/2001 | Kovesdi et al. | |
| 6,482,616 B1 | 11/2002 | Kovesdi et al. | |
| 6,514,943 B2 | 2/2003 | Kovesdi et al. | |
| 6,551,586 B1 | 4/2003 | Davidson et al. | |
| 6,677,156 B2 | 1/2004 | Brough et al. | |
| 6,682,929 B2 | 1/2004 | Brough et al. | |
| 7,195,896 B2 | 3/2007 | Kovesdi et al. | |
| 8,940,290 B2* | 1/2015 | Roy ....................... | C12N 15/86 424/93.2 |
| 2003/0165820 A1* | 9/2003 | Day ................. | G01N 33/56994 435/5 |
| 2004/0136963 A1 | 7/2004 | Wilson et al. | |
| 2008/0233650 A1 | 9/2008 | Gall et al. | |
| 2011/0223135 A1* | 9/2011 | Roy ....................... | C12N 15/86 424/93.2 |
| 2014/0248307 A1* | 9/2014 | Gall ..................... | C07K 14/005 424/199.1 |
| 2014/0248308 A1* | 9/2014 | McVey ................ | C07K 14/005 424/199.1 |
| 2014/0271711 A1 | 9/2014 | Brough et al. | |
| 2014/0314717 A1* | 10/2014 | Brough ................ | C07K 14/005 424/93.2 |

(Continued)

FOREIGN PATENT DOCUMENTS

| | | |
|---|---|---|
| WO | WO 94/28152 A1 | 12/1994 |
| WO | WO 95/02697 A2 | 1/1995 |
| WO | WO 95/16772 A1 | 6/1995 |

(Continued)

OTHER PUBLICATIONS

McGeoch et. al. Tegument protein and transactivator of immediate early genes. GenBank Acc. No. P89467. Dep. Oct. 31, 2006.*
Mural RJ, et. al. mCG1048340 [Mus musculus]. GenBank: EDL20708.1. Dep. Jun. 7, 2007.*
Dolan A, Jamieson FE, Cunningham C, Barnett BC, McGeoch DJ. The genome sequence of herpes simplex virus type 2. J Virol. Mar. 1998;72(3):2010-21.*
McGeoch et. al. RecName: Full=Major capsid protein; Short=MCP; AltName: Full=Capsid protein VP5. UniProtKB/Swiss-Prot: P89442.1. Dep. Nov. 11, 2005.*

(Continued)

*Primary Examiner* — Rachel B Gill
(74) *Attorney, Agent, or Firm* — Leydig, Voit & Mayer, Ltd.

(57) ABSTRACT

Herpes Simplex Virus (HSV) antigens that elicit an HSV-specific immune response and can be used to treat or prevent HSV infection are provided. Nucleic acid sequences, polypeptides, vectors, and compositions, as well as methods to induce an immune response against HSV, treat or prevent HSV disease, induce a T cell response against HSV, and induce an antibody response against HSV also are provided.

70 Claims, 15 Drawing Sheets

(56) References Cited

U.S. PATENT DOCUMENTS

| | | | |
|---|---|---|---|
| 2015/0152434 A1* | 6/2015 | Roy | C12N 15/86 514/44 R |
| 2015/0157700 A1 | 6/2015 | Bruder et al. | |

FOREIGN PATENT DOCUMENTS

| | | |
|---|---|---|
| WO | WO 95/34671 A1 | 12/1995 |
| WO | WO 96/22378 A1 | 7/1996 |
| WO | WO 97/00326 A1 | 1/1997 |
| WO | WO 97/12986 A2 | 4/1997 |
| WO | WO 97/21826 A2 | 6/1997 |
| WO | WO 00/00628 A1 | 1/2000 |
| WO | WO 00/34444 A2 | 6/2000 |
| WO | WO 03/020879 A2 | 3/2003 |
| WO | WO 03/022311 A1 | 3/2003 |
| WO | WO 2007/027860 A2 | 3/2007 |
| WO | WO 2008/011609 A2 | 1/2008 |
| WO | WO 2010/051367 A1 | 5/2010 |
| WO | WO 2011/057248 A2 | 5/2011 |

OTHER PUBLICATIONS

Roy et. al. Simian adenovirus 43, complete genome. GenBank: FJ025900. Dep. Jul. 9, 2009.*
Roy et. al. Simian adenovirus 45, complete genome. GenBank: FJ025901. Dep. Jul. 9, 2009.*
Altschul et al., "Basic Local Alignment Search Tool," *J. Molecular Biol.*, 215(3): 403-410 (1990).
Altschul et al., "Gapped BLAST and PSI-BLAST: a new generation of protein database search programs," *Nucleic Acids Res.*, 25(17): 3389-3402 (1997).
Aubert et al., "Accumulation of Herpes Simplex Virus Type 1 Early and LeakyLate Proteins Correlates with Apoptosis Prevention in infected Human Hep-2 Cells," *J. Virol.*, 75(2): 1013-1030 (2001).
Bai et al., "Mutations that alter an Arg-Gly-Asp (RGD) sequence in the adenovirus type 2 penton base protein abolish its cell-rounding activity and delay virus reproduction in flat cells," *J. Virol.*, 67(9): 5198-5205 (1993).
Biegert et al., "Sequence context-specific profiles for homology searching," *Proc. Natl. Acad. Sci. USA*, 106(10): 3770-3775 (2009).
Boulanger et al., "Characterization of adenovirus protein IX," *J. Gen. Virol.*, 44(3): 783-800 (1979).
Brough et al., "Activation of transgene expression by early region 4 is responsible for a high level of persistent transgene expression from adenovirus vectors in vivo," *J. Virol.*, 71(12): 9206-9213 (1997).
Cartier et al., "Hematopoietic stem cell gene therapy with a lentiviral vector in X-linked adrenoleukodystrophy," *Science*, 326(5954): 818-823 (2009).
Cavazzana-Calvo et al., "Gene therapy of human severe combined immunodeficiency (SCID)-X1 disease," *Science*, 288(5466): 669-672 (2000).
Chen et al., "Persistence in muscle of an adenoviral vector that lacks all viral genes," *Proc. Natl. Acad. Sci. USA*, 94(5): 1645-1650 (1997).
Chroboczek et al., "The sequence of the genome of adenovirus type 5 and its comparison with the genome of adenovirus type 2," *Virology*, 186(1): 280-285 (1992).
Crawford-Miksza et al., "Analysis of 15 adenovirus hexon proteins reveals the location and structure of seven hypervariable regions containing serotype-specific residues," *J. Virol.*, 70(3): 1836-1844 (1996).
Curiel et al., "High-efficiency gene transfer mediated by adenovirus coupled to DNA-polylysine complexes," *Hum. Gene Ther.*, 3(2): 147-154 (1992).
Devaux et al., "Structure of adenovirus fibre. I. Analysis of crystals of fibre from adenovirus serotypes 2 and 5 by electron microscopy and X-ray crystallography," *J. Molec. Biol.*, 215(4): 567-588 (1990).
Dey et al., "Molecular epidemiology of adenovirus infection among infants and children with acute gastroenteritis in Dhaka City, Bangladesh," *Infect. Genet. Evol.*, 9(4) 518-522 (2009).
European Patent Office, International Search Report in International Patent Application No. PCT/US/2013/041358 (Dec. 11, 2014).
Field et al., "Properties of the adenovirus DNA polymerase," *J. Biol. Chem.*, 259(15): 9487-9495 (1984).
Gall et al., "Construction and characterization of hexon-chimeric adenoviruses: specification of adenovirus serotype," *J. Virol.*, 72(12): 10260-10264 (1998).
Genbank Accession No. ABX79578, "UL47 [Human herpesvirus 2]" (Apr. 14, 2009).
Genbank Accession No. ABU95388.1, "Hexon, partial [Human adenovirus 9]," (Jun. 2009).
Genbank Accession No. CAB06743.1, "Major capsid protein [Human herpesvirus 2]" (Nov. 14, 2006).
Genbank Accession No. EDA88859.1, "Hypothetical protein GOS_1918841, partial [marine metagenome]," (Apr. 2007).
Genbank Accession No. FJ025900.1, "Simian adenovirus 43, complete genome," (Mar. 2012).
Genbank Accession No. FJ025901.1 "Simian adenovirus 45, complete genome," (Mar. 2012).
Genbank Accession No. JN163990.1, "Gorilla gorilla beringei adenovirus 6 hexon gene, partial cds," (Dec. 2011).
Genbank Accession No. KC702813.1,"Gorilla beringei beringei adenovirus 7 isolate GC44 hexon gene, complete cds" (Sep. 2013).
Genbank Accession No. KC702815.1, "Gorilla beringei graueri adenovirus 9 isolate GC46 hexon gene, complete cds," (Sep. 2013).
Genbank Accession No. KC702816, "Gorilla beringei beringei adenovirus 7 isolate GC44 DNA polymerase gene, complete cds," (Sep. 2013).
Ghosh-Choudhury et al., "Protein IX, a minor component of the human adenovirus capsid, is essential for the packaging of full length genomes," *EMBO J.*, 6(6): 1733-1739 (1987).
Ginsberg et al., "A proposed terminology for the adenovirus antigens and virion morphological subunits," *Virology*, 28(4): 782-783 (1966).
Goins et al., "Herpes simplex virus vector-mediated gene delivery for the treatment of lower urinary tract pain," *Gene Ther.*, 16(4): 558-569 (2009).
Graham et al., "Characteristics of a human cell line transformed by DNA from human adenovirus type 5," *J. Gen. Virol.*, 36(1): 59-72 (1977).
Green et al., "Evidence for a repeating cross-beta sheet structure in the adenovirus fibre," *EMBO J.*, 2(8): 1357-1365 (1983).
Hacein-Bey-Abina et al., "A serious adverse event after successful gene therapy for X-linked severe combined immunodeficiency," *N. Engl. J. Med.*, 348(3): 255-256 (2003).
Henry et al., "Characterization of the knob domain of the adenovirus type 5 fiber protein expressed in *Escherichia coli*," *J. Virol.*, 68(8): 5239-5246 (1994).
Horvath et al., "Nonpermissivity of human peripheral blood lymphocytes to adenovirus type 2 infection," *J. Virology*, 62(1): 341-345 (1988).
Jornvall et al., "The adenovirus hexon protein. The primary structure of the polypeptide and its correlation with the hexon gene," *J. Biol. Chem.*, 256(12): 6181-6186 (1981).
Kannan et al., "Structural and functional diversity of the microbial kinome," *PLoS Biol.*, 5(3) E17 (2007).
Kay et al., "Viral vectors for gene therapy: the art of turning infectious agents into vehicles of therapeutics," *Nature Medicine*, 7(1): 33-40 (2001).
Kochanek et al., "High-capacity adenoviral vectors for gene transfer and somatic gene therapy," *Hum. Gene Ther.*, 10(15): 2451-2459 (1999).
Koelle et al., "CD4 T-cell responses to herpes simplex virus type 2 major capsid protein VP5: Comparison with responses to tegument and envelope glycoproteins", *J. Virol.*, 74(23):11422-11425 (2000).
Kohlmann et al., "Protective efficacy and immunogenictiy of an adenoviral vector vaccine encoding the codon-optimized F protein of respiratory syncytial virus," *J Virol.* 83(23): 12601-12610 (2009).
Lasaro et al., "New insights on adenovirus as vaccine vectors," *Molecular Therapy*, 17(8): 1333-1339 (2009).

(56) References Cited

OTHER PUBLICATIONS

Lutz et al., "The product of the adenovirus intermediate gene IX is a transcriptional activator," *J. Virol.*, 71(7): 5102-5109 (1997).
Mayrhofer et al., "Nonreplicating vaccinia virus vectors expressing the H5 influenza virus hemagglutinin produced in modified Vero cells induce robust protection," *J. Virol.*, 83(10): 5192-5203 (2009).
Mease et al., "Safety, tolerability, and clinical outcomes after intraarticular injection of a recombinant adeno-associated vector containing a tumor necrosis factor antagonist gene: results of a phase 1/2 Study," Journal of Rheumatology, 37(4): 692-703 (2010).
Morsy et al., An adenoviral vector deleted for all viral coding sequences results in enhanced safety and extended expression of a leptin transgene, *Proc. Natl. Acad. Sci. USA*, 95: 7866-7871 (1998).
Muller et al., "Herpes simplex virus type 2 tegument proteins contain subdominant T-cell epitopes detectable in BALB/c mice after DNA immunization and infection", *J. Virol.*, 90 (5): 1153-1163 (2009).
NCBI reference sequence AP_000218, "E3 12.5K [Human adenovirus 5]," (Dec. 2008).
NCBI reference sequence AP_000224.1, "*Homo sapiens* genomic DNA, chromosome 21q21.2, LL56-APP region, clone:B2017A3, complete sequence," (Nov. 1991).
Neumann et al., "Determination of the nucleotide sequence for the penton-base gene of human adenovirus type 5," *Gene*, 69(1) 153-157 (1988).
Novelli et al., "Deletion analysis of functional domains in baculovirus-expressed adenovirus type 2 fiber," *Virology*, 185(1): 365-376 (1991).
Roberts et al., "Three-dimensional structure of the adenovirus major coat protein hexon," *Science*, 232(4754): 1148-1151 (1986).
Roy et al., "Isolation and Characterization of Adenoviruses Persistently Shed from the Gastrointestinal Tract of Non-Human Primates," *PLOS Pathogens*, 5(7): E1000503, 1-9, (2009).
Roy et al., "Generation of an adenoviral vaccine vector based on simian adenovirus 21," *Journal of General Virology* 87: 2477-2485 (2006).
Rusch et al., "The Sorcerer II Global Ocean Sampling expedition: northwest Atlantic through eastern tropical Pacific," *PLoS Biol.*, 5(3) E77 (2007).
Rux et al., "Structural and phylogenetic analysis of adenovirus hexons by use of high-resolution x-ray crystallographic, molecular modeling, and sequence-based methods," *J. Virol.*, 77(17): 9553-9566 (2003).
Signas et al., Adenovirus 3 Fiber Polypeptide Gene: Implications for the Structure of the Fiber Protein, *J. Virol.*, 53(2): 672-678 (1985).
Silver et al., "Interaction of human adenovirus serotype 2 with human lymphoid cells," *Virology*, 165(2): 377-387 (1988).
Soding, "Protein homology detection by HMM-HMM comparison," *Bioinformatics*, 21(7): 951-960 (2005).
Subak-Sharpe et al., "HSV Molecular Biology: General Aspects of Herpes Simplex Virus Molecular Biology", *Virus Genes*, 16(3): 239-251 (1998).
Stewart et al., "Image reconstruction reveals the complex molecular organization of adenovirus," *Cell*, 67(1): 145-154 (1991).
Stewart et al., "Difference imaging of adenovirus: bridging the resolution gap between X-ray crystallography and electron microscopy," *EMBO J.*, 12(7): 2589-99 (1993).
Thomas et al., "Progress and problems with the use of viral vectors for gene therapy," *Nature Review Genetics*, 4(5): 346-358 (2003).
Van Oostrum et al, "Molecular composition of the adenovirus type 2 virion," *J. Virol.*, 56(2): 439-448 (1985).
Wevers et al., "A novel adenovirus of Western lowland gorillas (*Gorilla gorilla gorilla*)," *J. Virology*, 7(1): 1-8 (2010).
Wevers et al., "Novel Adenoviruses in Wild Primates: a High Level of Genetic Diversity and Evidence of Zoonotic Transmissions," *J. Virology*, 85(20): 10774-10784, (2011).
Yeh et al., "Human adenovirus type 41 contains two fibers," *Virus Res.*, 33(2): 179-198 (1994).
Yooseph et al., "The Sorcerer II Global Ocean Sampling expedition: expanding the universe of protein families," *PLoS Biol.*, 5(3) E16, (2007).

\* cited by examiner

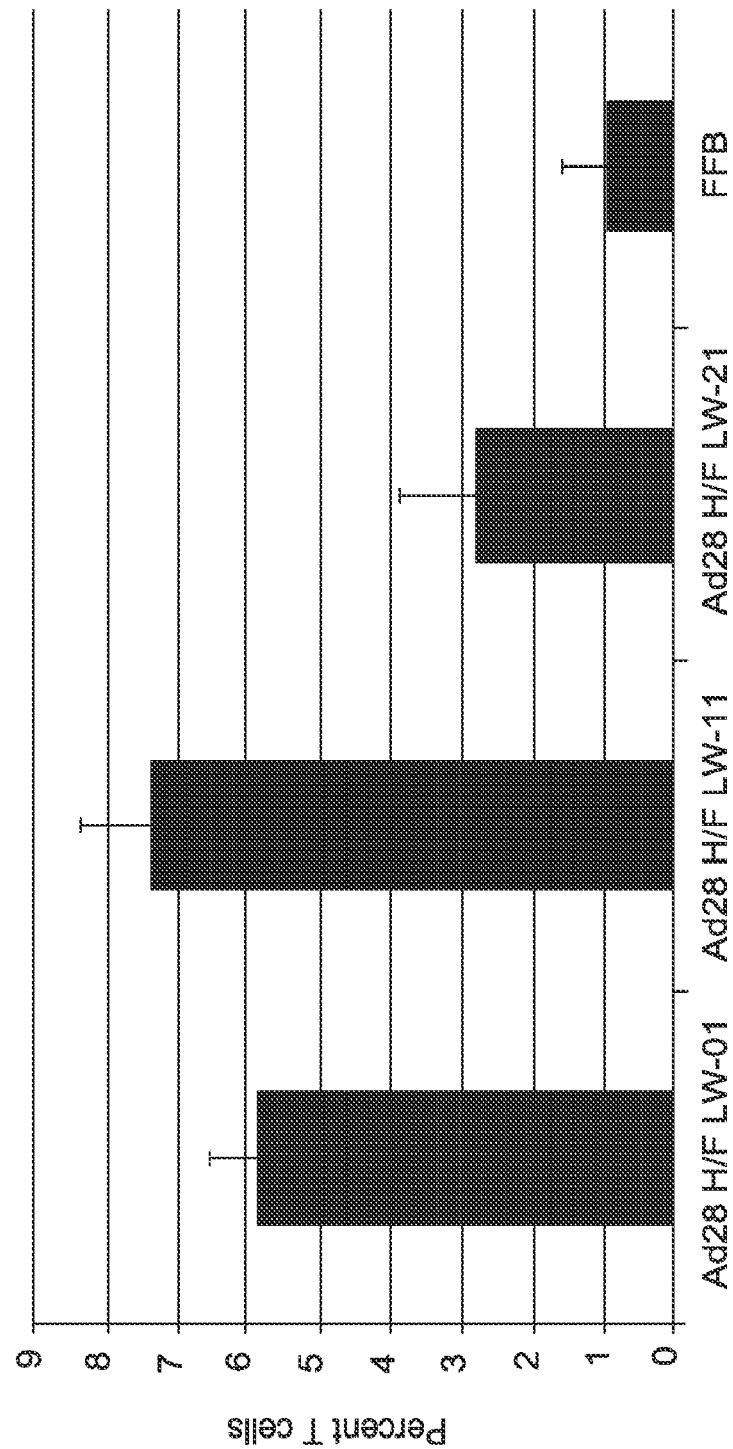

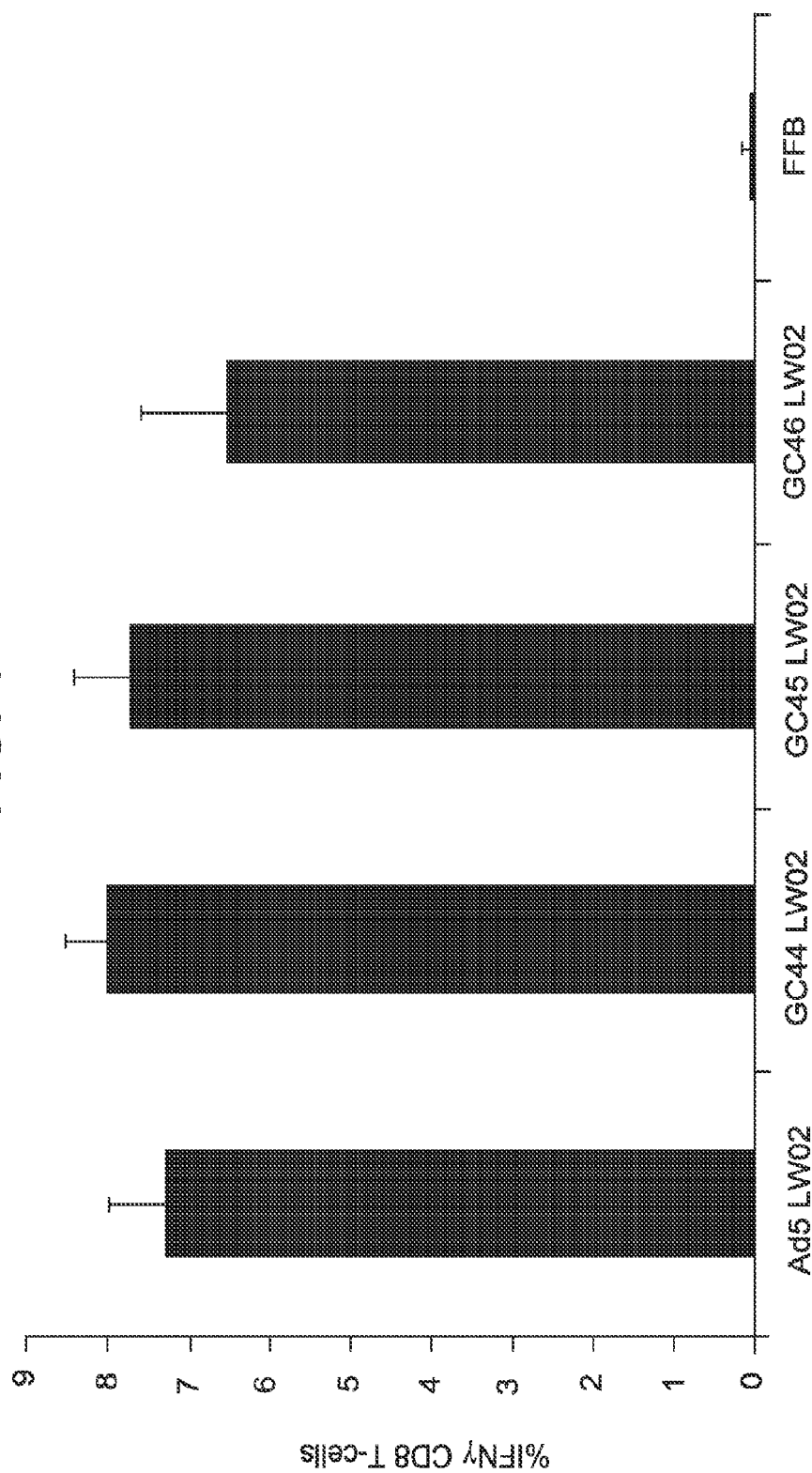

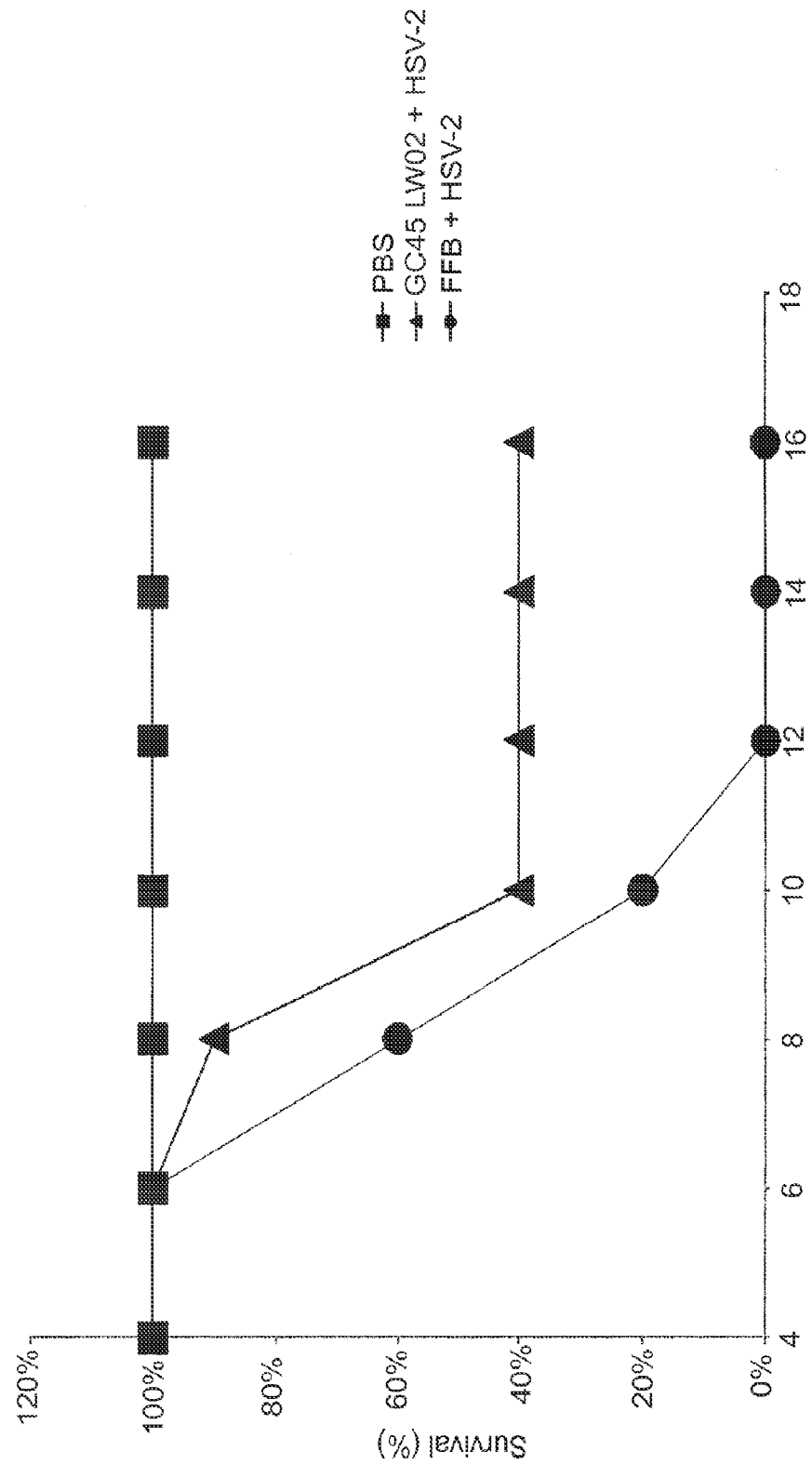

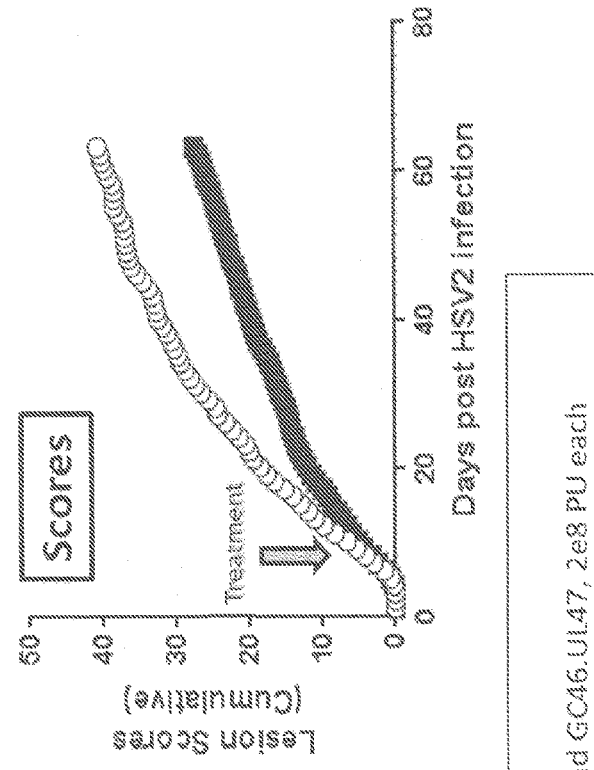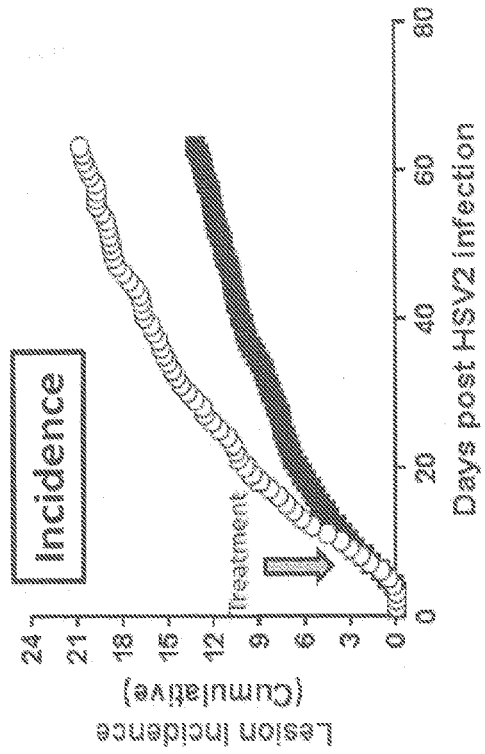

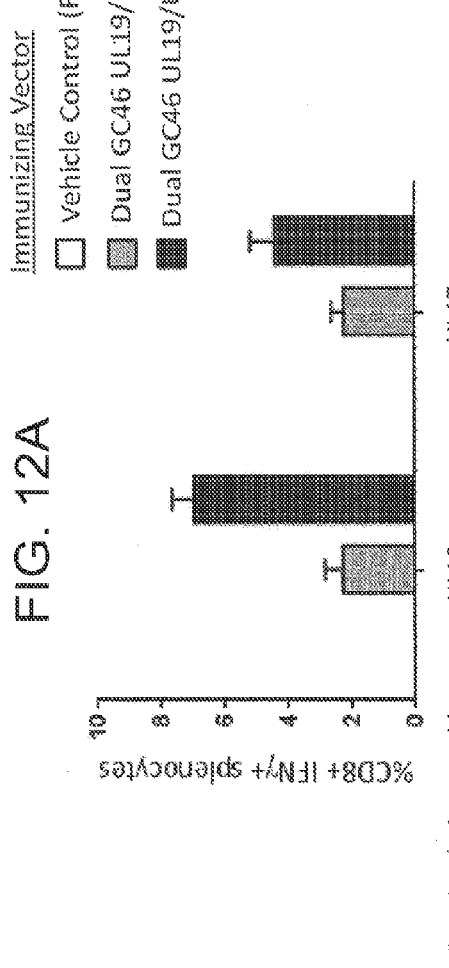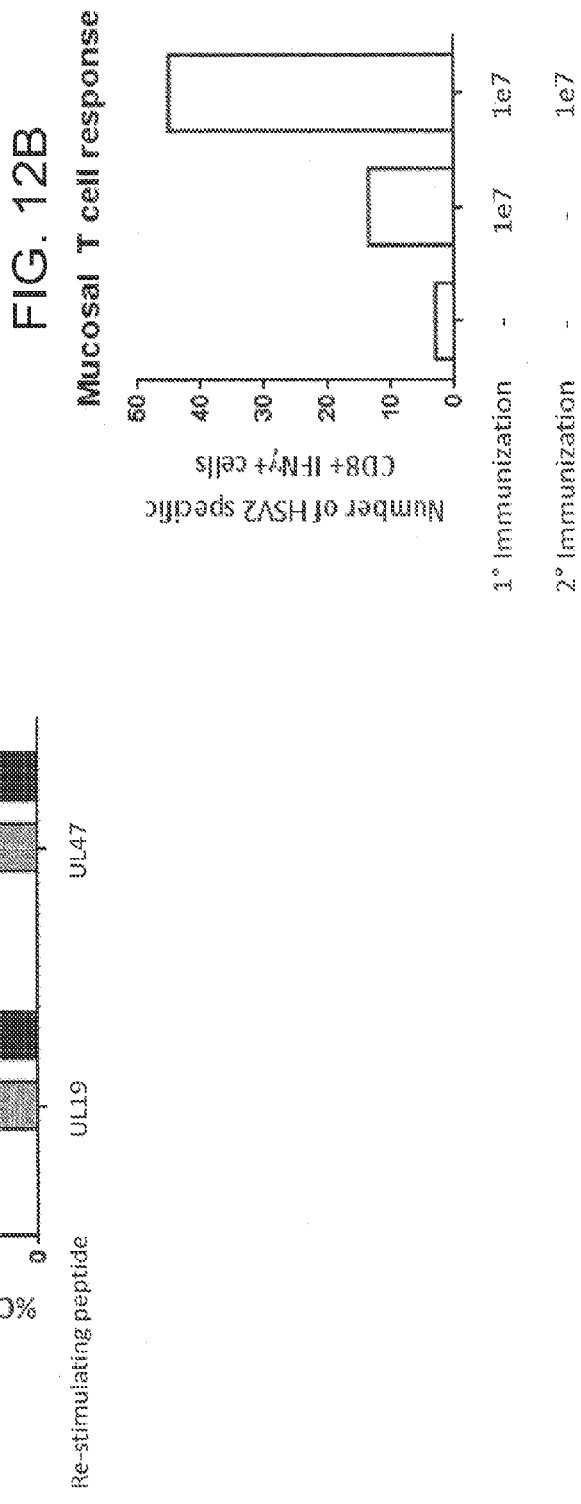

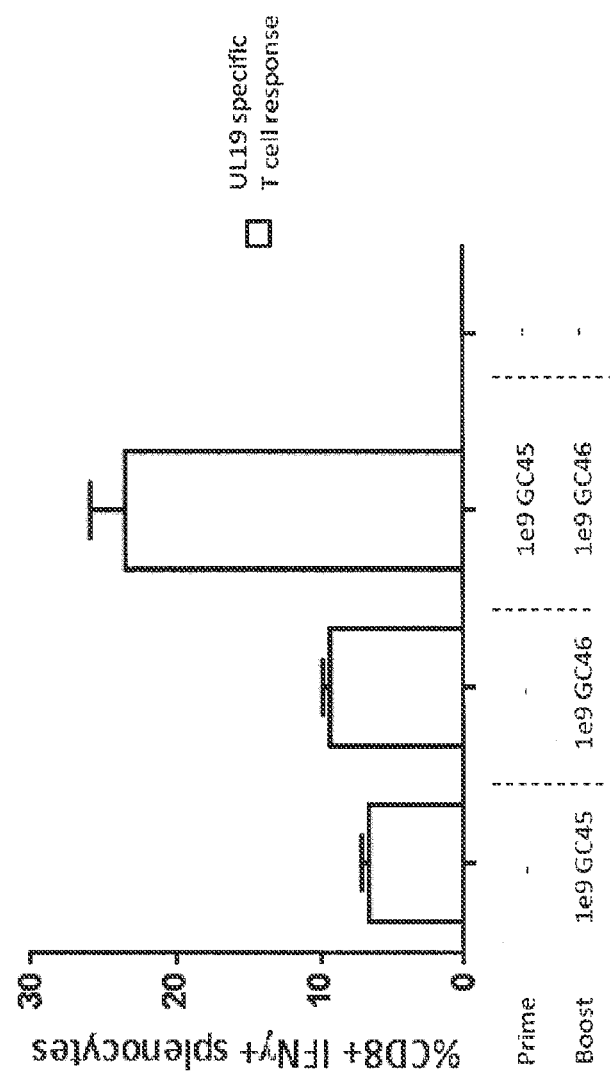

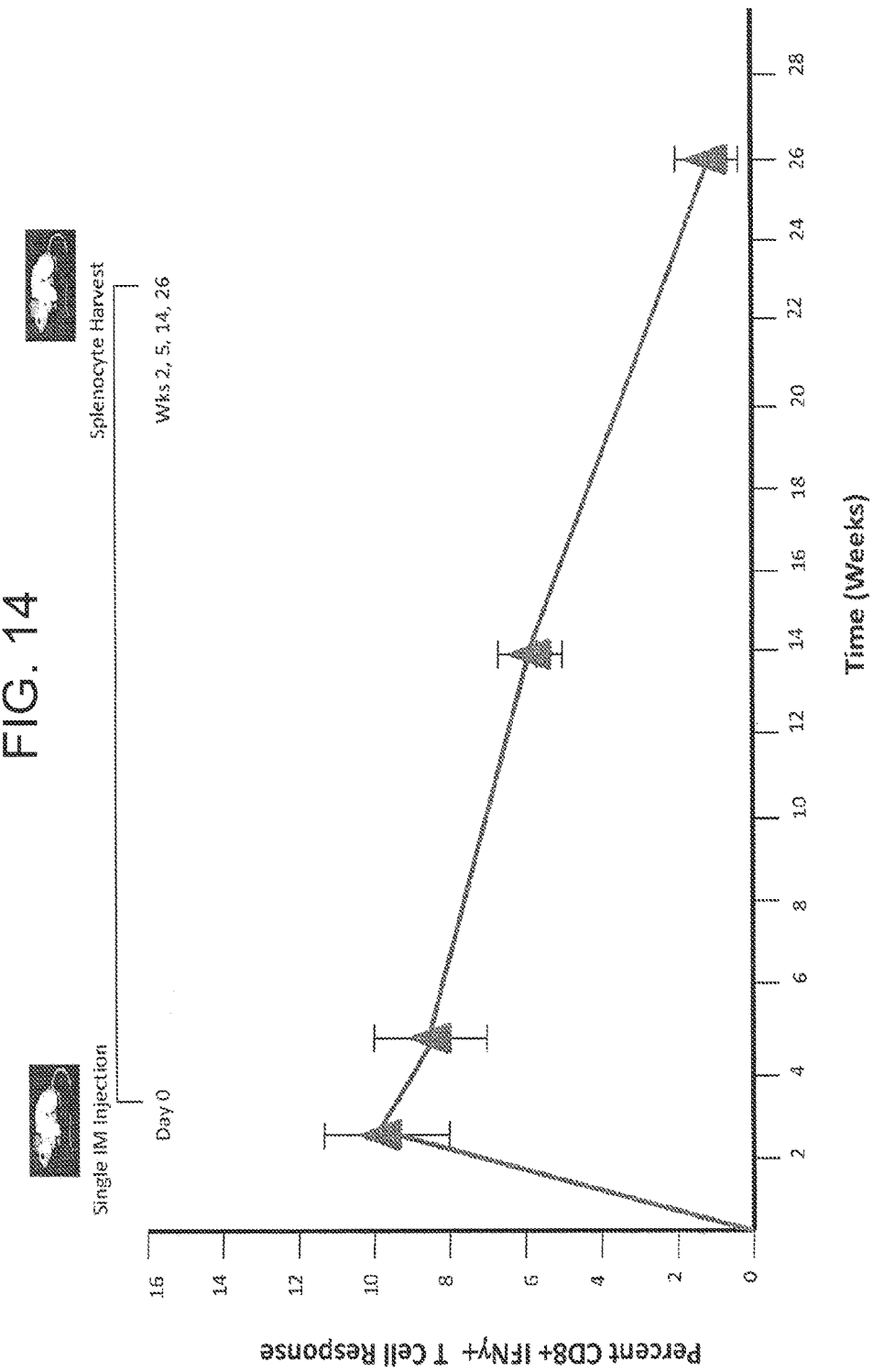

HERPES SIMPLEX VIRUS VACCINE

STATEMENT REGARDING FEDERALLY SPONSORED RESEARCH AND DEVELOPMENT

This invention was made with Government support under Grant Number 5R43AI077147-02 awarded by the National Institutes of Health. The Government has certain rights in this invention.

INCORPORATION-BY-REFERENCE OF MATERIAL ELECTRONICALLY SUBMITTED

Incorporated by reference in its entirety herein is a computer-readable nucleotide/amino acid sequence listing submitted concurrently herewith and identified as follows: 1,009,461 bytes ASCII (Text) file named "716196_ST25.txt" created Nov. 24, 2014.

BACKGROUND OF THE INVENTION

Herpes Simplex Virus 2 (HSV-2) is highly infectious and prevalent both in the United States and worldwide. Population based data have shown that in the U.S., 17.8% of the general U.S. population has acquired HSV-2 infection. In some demographic groups such as African American women, the seroprevalence approaches 60%. Women possess higher seroprevalence rates than men, and HSV-2 seroprevalence rates in many areas of the world are double that of the U.S. population.

Concomitant with the epidemic of HSV-2 in the U.S. is the increasing prevalence of neonatal HSV-2. An estimated 1,300 cases of neonatal HSV are seen yearly—a higher number of cases than neonatal HIV ever achieved in the U.S. Neonatal HSV, even treated, has a mortality of >15%, and the neurological morbidity among HSV-2 infected infants is an additional 30-50% of surviving cases. Case series indicate that 70% of neonatal HSV cases are related to the acquisition of HSV-1 or HSV-2 by the mother in late pregnancy.

The increasing prevalence of HSV-2 in the adult population has occurred despite the development and widespread use of antiviral therapy for HSV-2. Antecedent HSV-2 increases the risk of HIV infection by 2-3 fold. Data from Rakai, Uganda, show that on a per contact basis the HSV-2 infected person has a 5-7 fold increased rate of HIV-1 acquisition than the HSV-2 seronegative person. Mathematical modeling of the epidemiological data has indicated that from ⅓ to ½ of the cases of HIV-1 in areas of Africa such as Kisumu, Kenya, can be directly attributed to HSV-2. This effect on HIV is higher for HSV-2 than any other sexually transmitted illness (STI). HSV-2/HIV co-infected persons appear to be a major "super spreader" of HIV within their communities. In addition, large scale international studies have shown the ineffectiveness of antiviral therapy of HSV-2 to reduce HIV-1 acquisition and demonstrated the inability of acyclovir to reduce transmission between HIV-1 discordant couples.

The genome of Herpes Simplex Viruses (HSV-1 and HSV-2) contains about 85 open reading frames, such that HSV can generate at least 85 unique proteins. These genes encode 4 major classes of proteins: (1) those associated with the outermost external lipid bilayer of HSV (the envelope), (2) the internal protein coat (the capsid), (3) an intermediate complex connecting the envelope with the capsid coat (the tegument), and (4) proteins responsible for replication and infection.

Examples of envelope proteins include UL1 (gL), UL10 (gM), UL20, UL22, UL27 (gB), UL43, UL44 (gC), UL45, UL49A, UL53 (gK), US4 (gG), US5 (gJ), US6 (gD), US7 (gI), US8 (gE), and US10. Examples of capsid proteins include UL6, UL18, UL19, UL35, and UL38. Tegument proteins include UL11, UL13, UL21, UL36, UL37, UL41, UL45, UL46, UL47, UL48, UL49, US9, and US10. Other HSV proteins include UL2, UL3 UL4, UL5, UL7, UL8, UL9, UL12, UL14, UL15, UL16, UL17, UL23, UL24, UL25, UL26, UL26.5, UL28, UL29, UL30, UL31, UL32, UL33, UL34, UL39, UL40, UL42, UL50, UL51, UL52, UL54, UL55, UL56, US1, US2, US3, US81, US11, US12, ICP0, and ICP4.

Since the envelope (most external portion of an HSV particle) is the first to encounter target cells, much of the early HSV-2 vaccine development work focused on using proteins associated with the envelope as immunogenic agents. In brief, surface and membrane proteins—glycoprotein D (gD), glycoprotein B (gB), glycoprotein H (gH), glycoprotein L (gL)—as single antigens or in combination with or without adjuvants have been tested as possible vaccine antigens. Each was able to stimulate neutralizing antibody titers and "protect" HSV-2 infected animals in challenge models. In humans, all of these vaccines elicited HSV specific neutralizing antibodies among seronegative and HSV-1 seropositive individuals. Neutralizing antibody titers were found to be equal to or 5-10 fold higher than that measured in HSV-2 seropositive individuals.

The most promising candidate was glycoprotein D in which multiple clinical trials were conducted, including a very large Phase III trial. Results from this clinical trial showed that, though circulating neutralizing antibody titers were present and high, only 35% of the seronegative women showed a reduction in HSV-1 acquisition. No benefit was observed in men. These disappointing findings indicate that the stimulation of neutralizing antibodies is insufficient for an effective HSV-2 vaccine. More specifically, these results suggest that immunization with envelope proteins for induction of neutralizing antibodies is inadequate to generate an effective HSV vaccine.

There is a need for an effective HSV vaccine for the public health control of HSV infection.

BRIEF SUMMARY OF THE INVENTION

The invention provides an isolated or purified nucleic acid sequence with at least 74.5% identity to SEQ ID NO: 1. The invention provides an isolated or purified nucleic acid sequence encoding an amino acid sequence with at least 97% identity to SEQ ID NO: 2. The invention provides an isolated or purified nucleic acid sequence with at least 82.5% identity to SEQ ID NO: 5.

The invention also provides vectors comprising one or more of the above-described nucleic acid sequences, such as a vector comprising (i) a nucleic acid sequence with at least 74.5% identity to SEQ ID NO: 1 and (ii) a nucleic acid sequence with at least 82.5% identity to SEQ ID NO: 5.

The invention provides polypeptides encoded by the above-described nucleic acid sequences, such as a polypeptide comprising SEQ ID NO: 2.

The invention further provides compositions comprising (i) one or more of the above-described nucleic acid sequences, vectors, and/or polypeptides and (ii) a pharmaceutically acceptable carrier, as well as methods employing the compositions. In particular, the invention provides a method of inducing an immune response against HSV in a mammal, a method of preventing and/or treating HSV disease in a mammal, a method of inducing a T cell response against HSV in a mammal, and a method of inducing an antibody response against HSV in a mammal comprising administering the inventive composition.

The invention also provides for single or multiple administrations (e.g., homologous and/or heterologous administrations, such as priming and boosting compositions) to induce an immune response against HSV in a mammal, treat or prevent HSV disease in a mammal, induce an antibody response against HSV in a mammal, and/or induce a T cell response against HSV in a mammal.

BRIEF DESCRIPTION OF THE SEVERAL VIEWS OF THE DRAWING(S)

FIGS. 1A and 1B are graphs showing HSV-specific T cell responses following a single administration of HSV antigens delivered by an adenoviral vector ($1 \times 10^9$ particle units (PU)) to mice as compared to HSV-specific T cell responses following "natural" infection of mice by intravaginal administration ($1 \times 10^6$ plaque forming units (PFU)) of HSV-2. The negative control was a single intramuscular administration of Final Formulation Buffer (FFB) or vehicle. Each of FIGS. 1A and 1B has the percent of HSV-specific T cells on the y-axis. FIG. 1A demonstrates the T cell response following a single administration of an adenoviral vector comprising SEQ ID NO: 7 (designated LW01) as compared to a "natural" intravaginal infection of a high dose of herpes simplex virus (HSV). FIG. 1B demonstrates the T cell response following a single administration of an adenoviral vector comprising SEQ ID NO: 5 (designated LW02)) as compared to a "natural" intravaginal infection of a high dose of HSV. Both graphs show that a single vaccination with HSV antigens (SEQ ID NO: 7 or SEQ ID NO. 5) can produce HSV-specific T cell levels.

FIG. 2 is a graph showing the HSV-specific T cell response following single administration of an adenoviral vector comprising SEQ ID NO: 7 (designated LW01), SEQ ID NO: 1 (designated LW11), and SEQ ID NO: 3 (designated LW21) as compared to administration of a control (i.e., vehicle (FFB)). Percent HSV-specific T cells are indicated on the y-axis.

FIG. 3 is a graph showing the percent of IFNγ+ CD8+ T cells (HSV-specific T cells) on the y-axis. HSV-specific T cell levels are greater following two administrations (e.g., homologous or heterologous administrations) of an adenoviral vector comprising SEQ ID NO: 7 as compared to a single administration (Ad28 followed by FFB). Mice immunized with two different adenoviral vectors (e.g., adenoviral vector serotype 28 (Ad28) followed by a modified adenoviral vector serotype 28-designated Ad28H or Ad28 H/F) resulted in higher HSV-specific T cell levels than two administrations of the same adenoviral vector.

FIG. 4 is a graph showing the percent of IFNγ+ CD8+ T cells (HSV-specific T cells) on the y-axis. This graph shows that SEQ ID NO: 5 delivered by adenoviral vector serotype 5 (designated Ad5 LW02) and three other adenoviral vectors (designated GC44 LW02, GC45 LW02, and GC46 LW02) induce high HSV-specific T cell levels when compared to vehicle (FFB) administered mice.

FIGS. 5A and 5B are graphs which illustrate that immunization with an adenoviral vector encoding SEQ ID NO: 5 protects mice against infection with HSV. FIG. 5A has mean lesion score on the y-axis and day post HSV-2 infection on the x-axis. FIG. 5A shows that a single injection of an adenoviral vector comprising SEQ ID NO: 5 (designated as GC45 LW02) reduces the mean lesion score as compared to the administration of vehicle (FFB+HSV2) in an HSV mouse infection model. Non HSV-infected mice were administered phosphate buffer solution (PBS) intravaginally and served as a negative control for measurement of mean genital lesion score and as a positive control for survival. FIG. 5B has percent survival on the y-axis and days post HSV-2 infection on the x-axis. FIG. 5B illustrates that immunization with an adenoviral vector encoding SEQ ID NO: 5 protects mice infected with HSV.

FIG. 6A is a graph which depicts experimental data illustrating that a single administration a gorilla adenoviral vector comprising a nucleic acid sequence encoding the inventive UL19 antigen or UL47 antigen induces robust antigen-specific T cell responses. FIG. 6B is a graph which depicts experimental data illustrating that the T cell responses induced by a single administration a gorilla adenoviral vector comprising a nucleic acid sequence encoding the inventive UL19 antigen or UL47 antigen are more robust than T cell responses induced by infection with HSV2. Analysis is the mean response±SEM. Statistical analysis compared all groups using 2 way ANOVA with Tukey's correction representing * $p<0.001$ and ** $p<0.0001$.

FIGS. 10A and 10B are graphs which depict experimental data illustrating that a single administration of a blend of the gorilla adenoviral vectors GC46.UL19 and GC46.UL47 reduces incidence and severity of HSV2 lesions in infected guinea pigs.

FIG. 12A is a graph which depicts experimental data illustrating that a homologous prime/boost immunization method utilizing the GC46 UL19/UL47 adenoviral vector results in enhanced T cell responses as compared to single administration of the vector vector, and that the ability to enhance the T cell response is a feature that is applicable to both the inventive UL19 and UL47 antigens.

FIG. 12B is a graph which depicts experimental data illustrating that single administration of the GC46 UL19/UL47 adenoviral vector induces mucosal T cell responses in mice, and that a second administration of the GC46 UL19/UL47 adenoviral vector produces enhanced mucosal T cell responses as compared to a single administration of the GC46 UL19/UL47 vector.

FIG. 13 is a graph which depicts experimental data illustrating that a heterologous prime/boost immunization method utilizing GC45.UL19 as a prime followed by GC46.UL19 as a boost results in enhanced T cell responses as compared to a single administration of either GC45.UL19 or GC46.UL19 alone.

FIG. 14 is a graph which depicts experimental data illustrating that a single administration of the GC46.UL19 vector induces elevated durable CD8+ T cell responses for out to 26 weeks post-injection.

DETAILED DESCRIPTION OF THE INVENTION

Figure 1A:
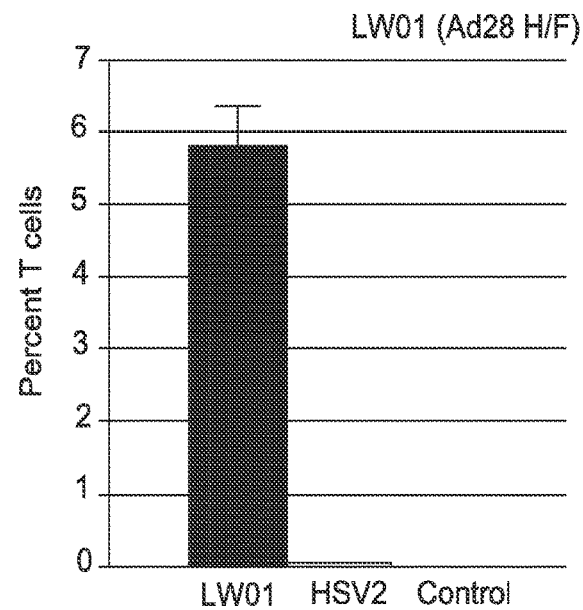

The invention is predicated, at least in part, on identification of HSV antigens that elicit an HSV (e.g., HSV-1 or HSV-2) specific immune response and/or protect against HSV challenge. The use of the inventive HSV antigens is therapeutically and prophylactically beneficial to patients with HSV and those at risk of contracting HSV infection.

In particular, a nucleic acid sequence encoding a truncated and modified HSV tegument antigen (UL47) that, because of its reduced size, can be more easily inserted into a variety of molecular delivery systems than the larger nucleic acid sequence encoding nontruncated (i.e., full-length) UL47. The smaller modified sequence (SEQ ID NO: 1) nevertheless produces robust T cell responses comparable to or greater than that induced by the nontruncated UL47 antigen. The inventive nucleic acid sequence can be used in a prophylactic and/or therapeutic vaccine for HSV infections.

The inventive (truncated and modified) UL47 antigen is encoded by a nucleic acid sequence that is at least 74.5% (e.g., at least 75%, at least 80%, at least 85%, at least 90%, or at least 95%) identical to SEQ ID NO: 1. For example, the inventive UL47 nucleic acid sequence can be at least 74.51%, at least 74.57%, at least 74.63%, at least 74.69%, at least 74.75%, at least 74.81%, at least 74.87%, at least 74.93%, at least 74.99%, at least 75.04%, at least 75.10%, at least 75.16%, at least 75.22%, at least 75.28%, at least 75.34%, at least 75.40%, at least 75.46%, at least 75.52%, at least 75.58%, at least 75.64%, at least 75.70%, at least 75.76%, at least 75.82%, at least 75.88%, at least 75.94%, at least 76.00%, at least 76.05%, at least 76.11%, at least 76.17%, at least 76.23%, at least 76.29%, at least 76.35%, at least 76.41%, at least 76.47%, at least 76.53%, at least 76.59%, at least 76.65%, at least 76.71%, at least 76.77%, at least 76.83%, at least 76.89%, at least 76.95%, at least 77.01%, at least 77.06%, at least 77.12%, at least 77.18%, at least 77.24%, at least 77.30%, at least 77.36%, at least 77.42%, at least 77.48%, at least 77.54%, at least 77.60%, at least 77.66%, at least 77.72%, at least 77.78%, at least 77.84%, at least 77.90%, at least 77.96%, at least 78.02%, at least 78.07%, at least 78.13%, at least 78.19%, at least 78.25%, at least 78.31%, at least 78.37%, at least 78.43%, at least 78.49%, at least 78.55%, at least 78.61%, at least 78.67%, at least 78.73%, at least 78.79%, at least 78.85%, at least 78.91%, at least 78.97%, at least 79.03%, at least 79.08%, at least 79.14%, at least 79.20%, at least 79.26%, at least 79.32%, at least 79.38%, at least 79.44%, at least 79.50%, at least 79.56%, at least 79.62%, at least 79.68%, at least 79.74%, at least 79.80%, at least 79.86%, at least 79.92%, at least 79.98%, at least 80.04%, at least 80.10%, at least 80.15%, at least 80.21%, at least 80.27%, at least 80.33%, at least 80.39%, at least 80.45%, at least 80.51%, at least 80.57%, at least 80.63%, at least 80.69%, at least 80.75%, at least 80.81%, at least 80.87%, at least 80.93%, at least 80.99%, at least 81.05%, at least 81.11%, at least 81.16%, at least 81.22%, at least 81.28%, at least 81.34%, at least 81.40%, at least 81.46%, at least 81.52%, at least 81.58%, at least 81.64%, at least 81.70%, at least 81.76%, at least 81.82%, at least 81.88%, at least 81.94%, at least 82.00%, at least 82.06%, at least 82.12%, at least 82.17%, at least 82.23%, at least 82.29%, at least 82.35%, at least 82.41%, at least 82.47%, at least 82.53%, at least 82.59%, at least 82.65%, at least 82.71%, at least 82.77%, at least 82.83%, at least 82.89%, at least 82.95%, at least 83.01%, at least 83.07%, at least 83.13%, at least 83.18%, at least 83.24%, at least 83.30%, at least 83.36%, at least 83.42%, at least 83.48%, at least 83.54%, at least 83.60%, at least 83.66%, at least 83.72%, at least 83.78%, at least 83.84%, at least 83.90%, at least 83.96%, at least 84.02%, at least 84.08%, at least 84.14%, at least 84.19%, at least 84.25%, at least 84.31%, at least 84.37%, at least 84.43%, at least 84.49%, at least 84.55%, at least 84.61%, at least 84.67%, at least 84.73%, at least 84.79%, at least 84.85%, at least 84.91%, at least 84.97%, at least 85.03%, at least 85.09%, at least 85.15%, at least 85.20%, at least 85.26%, at least 85.32%, at least 85.38%, at least 85.44%, at least 85.50%, at least 85.56%, at least 85.62%, at least 85.68%, at least 85.74%, at least 85.80%, at least 85.86%, at least 85.92%, at least 85.98%, at least 86.04%, at least 86.10%, at least 86.16%, at least 86.22%, at least 86.27%, at least 86.33%, at least 86.39%, at least 86.45%, at least 86.51%, at least 86.57%, at least 86.63%, at least 86.69%, at least 86.75%, at least 86.81%, at least 86.87%, at least 86.93%, at least 86.99%, at least 87.05%, at least 87.11%, at least 87.17%, at least 87.23%, at least 87.28%, at least 87.34%, at least 87.40%, at least 87.46%, at least 87.52%, at least 87.58%, at least 87.64%, at least 87.70%, at least 87.76%, at least 87.82%, at least 87.88%, at least 87.94%, at least 88.00%, at least 88.06%, at least 88.12%, at least 88.18%, at least 88.24%, at least 88.29%, at least 88.35%, at least 88.41%, at least 88.47%, at least 88.53%, at least 88.59%, at least 88.65%, at least 88.71%, at least 88.77%, at least 88.83%, at least 88.89%, at least 88.95%, at least 89.01%, at least 89.07%, at least 89.13%, at least 89.19%, at least 89.25%, at least 89.30%, at least 89.36%, at least 89.42%, at least 89.48%, at least 89.54%, at least 89.60%, at least 89.66%, at least 89.72%, at least 89.78%, at least 89.84%, at least 89.90%, at least 89.96%, at least 90.02%, at least 90.08%, at least 90.14%, at least 90.20%, at least 90.26%, at least 90.31%, at least 90.37%, at least 90.43%, at least 90.49%, at least 90.55%, at least 90.61%, at least 90.67%, at least 90.73%, at least 90.79%, at least 90.85%, at least 90.91%, at least 90.97%, at least 91.03%, at least 91.09%, at least 91.15%, at least 91.21%, at least 91.27%, at least 91.33%, at least 91.38%, at least 91.44%, at least 91.50%, at least 91.56%, at least 91.62%, at least 91.68%, at least 91.74%, at least 91.80%, at least 91.86%, at least 91.92%, at least 91.98%, at least 92.04%, at least 92.10%, at least 92.16%, at least 92.22%, at least 92.28%, at least 92.34%, at least 92.39%, at least 92.45%, at least 92.51%, at least 92.57%, at least 92.63%, at least 92.69%, at least 92.75%, at least 92.81%, at least 92.87%, at least 92.93%, at least 92.99%, at least 93.05%, at least 93.11%, at least 93.17%, at least 93.23%, at least 93.29%, at least 93.35%, at least 93.40%, at least 93.46%, at least 93.52%, at least 93.58%, at least 93.64%, at least 93.70%, at least 93.76%, at least 93.82%, at least 93.88%, at least 93.94%, at least 94.00%, at least 94.06%, at least 94.12%, at least 94.18%, at least 94.24%, at least 94.30%, at least 94.36%, at least 94.41%, at least 94.47%, at least 94.53%, at least 94.59%, at least 94.65%, at least 94.71%, at least 94.77%, at least 94.83%, at least 94.89%, at least 94.95%, at least 95.01%, at least 95.07%, at least 95.13%, at least 95.19%, at least 95.25%, at least 95.31%, at least 95.37%, at least 95.42%, at least 95.48%, at least 95.54%, at least 95.60%, at least 95.66%, at least 95.72%, at least 95.78%, at least 95.84%, at least 95.90%, at least 95.96%, at least 96.02%, 96.08%, at least 96.14%, at least 96.20%, at least 96.26%, at least 96.32%, at least 96.38%, at least 96.43%, at least 96.49%, at least 96.55%, at least 96.61%, at least 96.67%, at least 96.73%, at least 96.79%, at least 96.85%, at least 96.91%, at least 96.97%, at least 97.03%, at least 97.09%, at least 97.15%, at least 97.21%, at least 97.27%, at least 97.33%, at least 97.39%, at least 97.45%, at least 97.50%, at least 97.56%, at least 97.62%, at least 97.68%, at least 97.74%, at least 97.80%, at least 97.86%, at least 97.92%, at least 97.98%, at least 98.04%, at least 98.10%, at least 98.16%, at least 98.22%, at least 98.28%, at least 98.34%, at least 98.40%, at least 98.46%, at least 98.51%, at least 98.57%, at least 98.63%, at least 98.69%, at least 98.75%, at least 98.81%, at least 98.87%, at least 98.93%, at least 98.99%, at least 99.05%, at least 99.11%, at least 99.17%, at least 99.23%, at least 99.29%, at least 99.35%, at least 99.41%, at least 99.47%, at least 99.52%, at least 99.58%, at least 99.64%, at least 99.70%, at least 99.76%, at least 99.82%, at least 99.88%, or at least 99.94% identical to SEQ ID NO: 1. In a preferred embodiment, the inventive UL47 nucleic acid sequence comprises or consists of SEQ ID NO: 1.

The inventive nucleic acid sequence comprising at least 74.5% identity to SEQ ID NO: 1 preferably is codon-optimized to increase translation of antigen in infected cells, reduce HSV lesion severity, reduce viral shedding, and protect against HSV infection. The inventive nucleic acid sequence comprising at least 74.5% identity to SEQ ID NO: 1 desirably contains a C-terminal truncation to enhance antigen processing, and contains modifications relative to the nucleic acid sequence encoding the native amino acid sequence (GenBank Accession No. ABX79578), such as to effect amino acid substitutions at positions 291 and 294 in the encoded HSV antigen which preserve reactivity to HSV-1 and HSV-2. Moreover, the nucleic acid sequence comprising at least 74.5% identity to SEQ ID NO: 1 preferably increases the glutamic acid and threonine amino acid content of the translated protein (as indicated by PEST or PEST-like sequences which are signals for rapid protein degradation for MHC recognition).

The invention also provides a polypeptide encoded by the nucleic acid sequence comprising at least 74.5% identity to SEQ ID NO: 1. In particular, the invention provides a polypeptide comprising an amino acid sequence that is at least 97% (e.g., at least 98% or at least 99%) identical to SEQ ID NO: 2. For example, the polypeptide comprises an amino acid sequence that can be at least 97.15%, at least 97.33%, at least 97.50%, at least 97.68%, at least 97.86%, at least 98.04%, at least 98.22%, at least 98.40%, at least 98.57%, at least 98.75%, at least 98.93%, at least 99.11%, at least 99.29%, at least 99.47%, at least 99.64%, or at least 99.82% identical to SEQ ID NO: 2. In a preferred embodiment, the inventive polypeptide comprises or consists of the amino acid sequence of SEQ ID NO: 2.

Nucleic acid or amino acid sequence "identity," as described herein, can be determined by comparing a nucleic acid or amino acid sequence of interest to a reference nucleic acid or amino acid sequence. The number of nucleotides or amino acid residues that have been changed and/or modified (such as, e.g., by point mutations, insertions, or deletions) in the reference sequence so as to result in the sequence of interest are counted. The total number of such changes is subtracted from the total length of the sequence of interest, and the difference is divided by the length of the sequence of interest and expressed as a percentage. A number of mathematical algorithms for obtaining the optimal alignment and calculating identity between two or more sequences are known and incorporated into a number of available software programs. Examples of such programs include CLUSTAL-W, T-Coffee, and ALIGN (for alignment of nucleic acid and amino acid sequences), BLAST programs (e.g., BLAST 2.1, BL2SEQ, and later versions thereof) and FASTA programs (e.g., FASTA3x, FASTM, and SSEARCH) (for sequence alignment and sequence similarity searches). Sequence alignment algorithms also are disclosed in, for example, Altschul et al., *J. Molecular Biol.*, 215(3): 403-410 (1990); Beigert et al., *Proc. Natl. Acad. Sci. USA*, 106(10): 3770-3775 (2009); Durbin et al., eds., *Biological Sequence Analysis: Probalistic Models of Proteins and Nucleic Acids*, Cambridge University Press, Cambridge, UK (2009); Soding, *Bioinformatics*, 21(7): 951-960 (2005); Altschul et al., *Nucleic Acids Res.*, 25(17): 3389-3402 (1997); and Gusfield, *Algorithms on Strings, Trees and Sequences*, Cambridge University Press, Cambridge UK (1997)).

The invention also provides a nucleic acid sequence encoding an HSV capsid antigen (UL19) that produces robust T cell responses, reduces lesions, protects in an HSV challenge model, and can be used in a prophylactic and/or therapeutic vaccine for HSV infection. The usefulness of the inventive UL19 as an HSV antigen is unexpected because the capsid protein is an internal structural protein and is produced in the late phases of herpes viral replication and, thus, previously had not been considered to be a good antigen for antibody or T cell responses (see Aubert et al., *J. Virol.*, 75(2), 1013-1030 (2001)). Yet, the UL19 antigen produced by the nucleic acid sequence is very immunogenic and produces high T cell levels.

The UL19 antigen is encoded by a nucleic acid sequence that is at least 82.5% (e.g., at least 85%, at least 90%, at least 95%) identical to SEQ ID NO: 5. For example, the inventive UL19 nucleic acid sequence can be at least 82.46%, at least 82.48%, at least 82.51%, at least 82.53%, at least 82.56%, at least 82.58%, at least 82.61%, at least 82.63%, at least 82.65%, at least 82.68%, at least 82.70%, at least 82.73%, at least 82.75%, at least 82.78%, at least 82.80%, at least 82.82%, at least 82.85%, at least 82.87%, at least 82.90%, at least 82.92%, at least 82.95%, at least 82.97%, at least 82.99%, at least 83.02%, at least 83.04%, at least 83.07%, at least 83.09%, at least 83.11%, at least 83.14%, at least 83.16%, at least 83.19%, at least 83.21%, at least 83.24%, at least 83.26%, at least 83.28%, at least 83.31%, at least 83.33%, at least 83.36%, at least 83.38%, at least 83.41%, at least 83.43%, at least 83.45%, at least 83.48%, at least 83.50%, at least 83.53%, at least 83.55%, at least 83.58%, at least 83.60%, at least 83.62%, at least 83.65%, at least 83.67%, at least 83.70%, at least 83.72%, at least 83.75%, at least 83.77%, at least 83.79%, at least 83.82%, at least 83.84%, at least 83.87%, at least 83.89%, at least 83.92%, at least 83.94%, at least 83.96%, at least 83.99%, at least 84.01%, at least 84.04%, at least 84.06%, at least 84.09%, at least 84.11%, at least 84.13%, at least 84.16%, at least 84.18%, at least 84.21%, at least 84.23%, at least 84.26%, at least 84.28%, at least 84.30%, at least 84.33%, at least 84.35%, at least 84.38%, at least 84.40%, at least 84.43%, at least 84.45%, at least 84.47%, at least 84.50%, at least 84.52%, at least 84.55%, at least 84.57%, at least 84.59%, at least 84.62%, at least 84.64%, at least 84.67%, at least 84.69%, at least 84.72%, at least 84.74%, at least 84.76%, at least 84.79%, at least 84.81%, at least 84.84%, at least 84.86%, at least 84.89%, at least 84.91%, at least 84.93%, at least 84.96%, at least 84.98%, at least 85.01%, at least 85.03%, at least 85.06%, at least 85.08%, at least 85.10%, at least 85.13%, at least 85.15%, at least 85.18%, at least 85.20%, at least 85.23%, at least 85.25%, at least 85.27%, at least 85.30%, at least 85.32%, at least 85.35%, at least 85.37%, at least 85.40%, at least 85.42%, at least 85.44%, at least 85.47%, at least 85.49%, at least 85.52%, at least 85.54%, at least 85.57%, at least 85.59%, at least 85.61%, at least 85.64%, at least 85.66%, at least 85.69%, at least 85.71%, at least 85.74%, at least 85.76%, at least 85.78%, at least 85.81%, at least 85.83%, at least 85.86%, at least 85.88%, at least 85.90%, at least 85.93%, at least 85.95%, at least 85.98%, at least 86.00%, at least 86.03%, at least 86.05%, at least 86.07%, at least 86.10%, at least 86.12%, at least 86.15%, at least 86.17%, at least 86.20%, at least 86.22%, at least 86.24%, at least 86.27%, at least 86.29%, at least 86.32%, at least 86.34%, at least 86.37%, at least 86.39%, at least 86.41%, at least 86.44%, at least 86.46%, at least 86.49%, at least 86.51%, at least 86.54%, at least 86.56%, at least 86.58%, at least 86.61%, at least 86.63%, at least 86.66%, at least 86.68%, at least 86.71%, at least 86.73%, at least 86.75%, at least 86.78%, at least 86.80%, at least 86.83%, at least 86.85%, at least 86.88%, at least 86.90%, at least 86.92%, at least 86.95%, at least 86.97%, at least 87.00%, at least 87.02%, at least 87.05%, at least 87.07%, at least 87.09%, at least 87.12%, at least 87.14%, at least 87.17%, at least 87.19%, at least 87.21%, at least 87.24%, at least 87.26%, at least 87.29%, at least 87.31%, at least 87.34%, at least 87.36%, at least 87.38%, at least 87.41%, at least 87.43%, at least 87.46%, at least 87.48%, at least 87.51%, at least 87.53%, at least 87.55%, at least 87.58%, at least 87.60%, at least 87.63%, at least 87.65%, at least 87.68%, at least 87.70%, at least 87.72%, at least 87.75%, at least 87.77%, at least 87.80%, at least 87.82%, at least 87.85%, at least 87.87%, at least 87.89%, at least 87.92%, at least 87.94%, at least 87.97%, at least 87.99%, at least 88.02%, at least 88.04%, at least 88.06%, at least 88.09%, at least 88.11%, at least 88.14%, at least 88.16%, at least 88.19%, at least 88.21%, at least 88.23%, at least 88.26%, at least 88.28%, at least 88.31%, at least 88.33%, at least 88.36%, at least 88.38%, at least 88.40%, at least 88.43%, at least 88.45%, at least 88.48%, at least 88.50%, at least 88.52%, at least 88.55%, at least 88.57%, at least 88.60%, at least 88.62%, at least 88.65%, at least 88.67%, at least 88.69%, at least 88.72%, at least 88.74%, at least 88.77%, at least 88.79%, at least 88.82%, at least 88.84%, at least 88.86%, at least 88.89%, at least 88.91%, at least 88.94%, at least 88.96%, at least 88.99%, at least 89.01%, at least 89.03%, at least 89.06%, at least 89.08%, at least 89.11%, at least 89.13%, at least 89.16%, at least 89.18%, at least 89.20%, at least 89.23%, at least 89.25%, at least 89.28%, at least 89.30%, at least 89.33%, at least 89.35%, at least 89.37%, at least 89.40%, at least 89.42%, at least 89.45%, at least 89.47%, at least 89.50%, at least 89.52%, at least 89.54%, at least 89.57%, at least 89.59%, at least 89.62%, at least 89.64%, at least 89.67%, at least 89.69%, at least 89.71%, at least 89.74%, at least 89.76%, at least 89.79%, at least 89.81%, at least 89.84%, at least 89.86%, at least 89.88%, at least 89.91%, at least 89.93%, at least 89.96%, at least 89.98%, at least 90.00%, at least 90.03%, at least 90.05%, at least 90.08%, at least 90.10%, at least 90.13%, at least 90.15%, at least 90.17%, at least 90.20%, at least 90.22%, at least 90.25%, at least 90.27%, at least 90.30%, at least 90.32%, at least 90.34%, at least 90.37%, at least 90.39%, at least 90.42%, at least 90.44%, at least 90.47%, at least 90.49%, at least 90.51%, at least 90.54%, at least 90.56%, at least 90.59%, at least 90.61%, at least 90.64%, at least 90.66%, at least 90.68%, at least 90.71%, at least 90.73%, at least 90.76%, at least 90.78%, at least 90.81%, at least 90.83%, at least 90.85%, at least 90.88%, at least 90.90%, at least 90.93%, at least 90.95%, at least 90.98%, at least 91.00%, at least 91.02%, at least 91.05%, at least 91.07%, at least 91.10%, at least 91.12%, at least 91.15%, at least 91.17%, at least 91.19%, at least 91.22%, at least 91.24%, at least 91.27%, at least 91.29%, at least 91.31%, at least 91.34%, at least 91.36%, at least 91.39%, at least 91.41%, at least 91.44%, at least 91.46%, at least 91.48%, at least 91.51%, at least 91.53%, at least 91.56%, at least 91.58%, at least 91.61%, at least 91.63%, at least 91.65%, at least 91.68%, at least 91.70%, at least 91.73%, at least 91.75%, at least 91.78%, at least 91.80%, at least 91.82%, at least 91.85%, at least 91.87%, at least 91.90%, at least 91.92%, at least 91.95%, at least 91.97%, at least 91.99%, at least 92.02%, at least 92.04%, at least 92.07%, at least 92.09%, at least 92.12%, at least 92.14%, at least 92.16%, at least 92.19%, at least 92.21%, at least 92.24%, at least 92.26%, at least 92.29%, at least 92.31%, at least 92.33%, at least 92.36%, at least 92.38%, at least 92.41%, at least 92.43%, at least 92.46%, at least 92.48%, at least 92.50%, at least 92.53%, at least 92.55%, at least 92.58%, at least 92.60%, at least 92.62%, at least 92.65%, at least 92.67%, at least 92.70%, at least 92.72%, at least 92.75%, at least 92.77%, at least 92.79%, at least 92.82%, at least 92.84%, at least 92.87%, at least 92.89%, at least 92.92%, at least 92.94%, at least 92.96%, at least 92.99%, at least 93.01%, at least 93.04%, at least 93.06%, at least 93.09%, at least 93.11%, at least 93.13%, at least 93.16%, at least 93.18%, at least 93.21%, at least 93.23%, at least 93.26%, at least 93.28%, at least 93.30%, at least 93.33%, at least 93.35%, at least 93.38%, at least 93.40%, at least 93.43%, at least 93.45%, at least 93.47%, at least 93.50%, at least 93.52%, at least 93.55%, at least 93.57%, at least 93.60%, at least 93.62%, at least 93.64%, at least 93.67%, at least 93.69%, at least 93.72%, at least 93.74%, at least 93.77%, at least 93.79%, at least 93.81%, at least 93.84%, at least 93.86%, at least 93.89%, at least 93.91%, at least 93.93%, at least 93.96%, at least 93.98%, at least 94.01%, at least 94.03%, at least 94.06%, at least 94.08%, at least 94.10%, at least 94.13%, at least 94.15%, at least 94.18%, at least 94.20%, at least 94.23%, at least 94.25%, at least 94.27%, at least 94.30%, at least 94.32%, at least 94.35%, at least 94.37%, at least 94.40%, at least 94.42%, at least 94.44%, at least 94.47%, at least 94.49%, at least 94.52%, at least 94.54%, at least 94.57%, at least 94.59%, at least 94.61%, at least 94.64%, at least 94.66%, at least 94.69%, at least 94.71%, at least 94.74%, at least 94.76%, at least 94.78%, at least 94.81%, at least 94.83%, at least 94.86%, at least 94.88%, at least 94.91%, at least 94.93%, at least 94.95%, at least 94.98%, at least 95.00%, at least 95.03%, at least 95.05%, at least 95.08%, at least 95.10%, at least 95.12%, at least 95.15%, at least 95.17%, at least 95.20%, at least 95.22%, at least 95.25%, at least 95.27%, at least 95.29%, at least 95.32%, at least 95.34%, at least 95.37%, at least 95.39%, at least 95.41%, at least 95.44%, at least 95.46%, at least 95.49%, at least 95.51%, at least 95.54%, at least 95.56%, at least 95.58%, at least 95.61%, at least 95.63%, at least 95.66%, at least 95.68%, at least 95.71%, at least 95.73%, at least 95.75%, at least 95.78%, at least 95.80%, at least 95.83%, at least 95.85%, at least 95.88%, at least 95.90%, at least 95.92%, at least 95.95%, at least 95.97%, at least 96.00%, at least 96.02%, at least 96.05%, at least 96.07%, at least 96.09%, at least 96.12%, at least 96.14%, at least 96.17%, at least 96.19%, at least 96.22%, at least 96.24%, at least 96.26%, at least 96.29%, at least 96.31%, at least 96.34%, at least 96.36%, at least 96.39%, at least 96.41%, at least 96.43%, at least 96.46%, at least 96.48%, at least 96.51%, at least 96.53%, at least 96.56%, at least 96.58%, at least 96.60%, at least 96.63%, at least 96.65%, at least 96.68%, at least 96.70%, at least 96.72%, at least 96.75%, at least 96.77%, at least 96.80%, at least 96.82%, at least 96.85%, at least 96.87%, at least 96.89%, at least 96.92%, at least 96.94%, at least 96.97%, at least 96.99%, at least 97.02%, at least 97.04%, at least 97.06%, at least 97.09%, at least 97.11%, at least 97.14%, at least 97.16%, at least 97.19%, at least 97.21%, at least 97.23%, at least 97.26%, at least 97.28%, at least 97.31%, at least 97.33%, at least 97.36%, at least 97.38%, at least 97.40%, at least 97.43%, at least 97.45%, at least 97.48%, at least 97.50%, at least 97.53%, at least 97.55%, at least 97.57%, at least 97.60%, at least 97.62%, at least 97.65%, at least 97.67%, at least 97.70%, at least 97.72%, at least 97.74%, at least 97.77%, at least 97.79%, at least 97.82%, at least 97.84%, at least 97.87%, at least 97.89%, at least 97.91%, at least 97.94%, at least 97.96%, at least 97.99%, at least 98.01%, at least 98.03%, at least 98.06%, at least 98.08%, at least 98.11%, at least 98.13%, at least 98.16%, at least 98.18%, at least 98.20%, at least 98.23%, at least 98.25%, at least 98.28%, at least 98.30%, at least 98.33%, at least 98.35%, at least 98.37%, at least 98.40%, at least 98.42%, at least 98.45%, at least 98.47%, at least 98.50%, at least 98.52%, at least 98.54%, at least 98.57%, at least 98.59%, at least 98.62%, at least 98.64%, at least 98.67%, at least 98.69%, at least 98.71%, at least 98.74%, at least 98.76%, at least 98.79%, at least 98.81%, at least 98.84%, at least 98.86%, at least 98.88%, at least 98.91%, at least 98.93%, at least 98.96%, at least 98.98%, at least 99.01%, at least 99.03%, at least 99.05%, at least 99.08%, at least 99.10%, at least 99.13%, at least 99.15%, at least 99.18%, at least 99.20%, at least 99.22%, at least 99.25%, at least 99.27%, at least 99.30%, at least 99.32%, at least 99.34%, at least 99.37%, at least 99.39%, at least 99.42%, at least 99.44%, at least 99.47%, at least 99.49%, at least 99.51%, at least 99.54%, at least 99.56%, at least 99.59%, at least 99.61%, at least 99.64%, at least 99.66%, at least 99.68%, at least 99.71%, at least 99.73%, at least 99.76%, at least 99.78%, at least 99.81%, at least 99.83%, at least 99.85%, at least 99.88%, at least 99.90%, at least 99.93%, at least 99.95%, or at least 99.98% identical to SEQ ID NO: 5. In a preferred embodiment, the inventive nucleic acid sequence comprises or consists of SEQ ID NO: 5.

The inventive nucleic acid sequence comprising at least 82.5% identity to SEQ ID NO: 5 preferably is codon-optimized to increase translation of antigen in infected cells, reduce HSV lesion severity, reduce viral shedding, and protect against HSV infection. The nucleic acid sequence comprising at least 82.5% identity to SEQ ID NO: 5 preferably encodes a polypeptide comprising SEQ ID NO: 6 (corresponding to GenBank Accession No. CAB06743.1).

The inventive nucleic acids described herein can comprise DNA or RNA, and can be single or double stranded. Furthermore, the nucleic acids can comprise nucleotide analogues or derivatives (e.g., inosine or phosphorothioate nucleotides and the like). Each nucleic acid can encode a polypeptide alone or as part of a fusion protein. For example, the nucleic acids of the invention can encode a fusion protein comprising HSV antigen(s) and ubiquitin.

In one embodiment, the inventive nucleic acid sequence comprising at least 74.5% identity to SEQ ID NO: 1 also comprises a nucleic acid sequence that encodes ubiquitin.

For example, the inventive nucleic acid sequence can comprise SEQ ID NO: 3, and the resulting polypeptide can comprise SEQ ID NO: 4.

Each nucleic acid encoding a polypeptide can be provided as part of a construct comprising the nucleic acid and elements that enable delivery of the nucleic acid to a cell, and/or expression of the nucleic acid in a cell. Such elements include, for example, expression vectors, promoters, and transcription and/or translation sequences. Suitable vectors, promoters, transcription/translation sequences, and other elements, as well as methods of preparing such nucleic acids and constructs, are known in the art (e.g., Sambrook et al., *Molecular Cloning: A Laboratory Manual*, 3$^{rd}$ ed., Cold Spring Harbor Press, Cold Spring Harbor, N.Y. (2001); and Ausubel et al., *Current Protocols in Molecular Biology*, Greene Publishing Associates and John Wiley & Sons, New York (1994)).

The inventive polypeptide can be prepared by any method, such as by synthesizing the polypeptide or by expressing a nucleic acid encoding an appropriate amino acid sequence in a cell and harvesting the peptide from the cell or media containing the cell. A combination of such methods also can be used. Methods of de novo synthesizing polypeptides and methods of recombinantly producing polypeptides are known in the art (see, e.g., Chan et al., *Fmoc Solid Phase Peptide Synthesis*, Oxford University Press, Oxford, United Kingdom (2005); Reid, R. (ed.), *Peptide and Protein Drug Analysis*, Marcel Dekker, Inc. (2000); Westwood et al. (ed.), *Epitope Mapping*, Oxford University Press, Oxford, United Kingdom (2000); Sambrook et al., *Molecular Cloning: A Laboratory Manual*, 3$^{rd}$ ed., Cold Spring Harbor Press, Cold Spring Harbor, N.Y. (2001); and Ausubel et al., *Current Protocols in Molecular Biology*, Greene Publishing Associates and John Wiley & Sons, New York (1994)).

The invention provides a vector comprising one or more nucleic acid sequences comprising or consisting of a wild-type or inventive UL19 and/or wild-type or inventive UL47 nucleic acid sequence(s). Additionally, the invention also provides a composition comprising multiple vectors, each of which comprises or consists of one or more nucleic acid sequences comprising the wild-type or inventive UL19 and/or wild-type or inventive UL47 nucleic acid sequence(s). The above-described vectors also can comprise one or more nucleic acid sequences encoding one or more additional antigens (e.g., HSV antigens), though the vectors comprising the wild-type UL19 and/or wild-type UL47 nucleic acid sequences desirably do not include any other HSV antigen nucleic acid sequences.

An "antigen" is a molecule that triggers an immune response in a mammal. An "immune response" can entail, for example, antibody production and/or the activation of immune effector cells. An antigen in the context of the invention can comprise any subunit, fragment, or epitope of any proteinaceous or non-proteinaceous (e.g., carbohydrate or lipid) molecule that provokes an immune response in a mammal. By "epitope" is meant a sequence of an antigen that is recognized by an antibody or an antigen receptor. Epitopes also are referred to in the art as "antigenic determinants." The antigen can be a protein or peptide of viral, bacterial, parasitic, fungal, protozoan, prion, cellular, or extracellular origin, which provokes an immune response in a mammal, preferably leading to protective immunity.

Any vector can be employed in the context of the invention, including viral and non-viral vectors. Examples of suitable viral vectors include, but are not limited to, retroviral vectors, adeno-associated virus vectors, poxviral vectors (e.g., vaccinia virus vectors), herpesvirus vectors, parainfluenza-RSV chimeric vectors (PIV-RSV), adenoviral vectors, poliovirus, alphavirus, baculovirus, and Sindbis virus. Examples of suitable non-viral vectors include, but are not limited to, plasmids (e.g., DNA plasmids), yeast (e.g., Saccharomyces), liposomes, nanoparticles, and molecular conjugates (e.g., transferrin). When the vector is a plasmid (e.g., DNA plasmid), the plasmid can be complexed with adjuvants, such as CpG or polymeric adjuvants.

Preferably, the vector is an adenoviral vector. Adenovirus from various origins, subtypes, or mixture of subtypes can be used as the source of the viral genome for the adenoviral vector.

Non-human adenovirus (e.g., ape, simian, avian, canine, ovine, or bovine adenoviruses) can be used to generate the adenoviral vector (i.e., as a source of the adenoviral genome for the adenoviral vector). In one embodiment, a non-human primate adenovirus (e.g., ape, simian, of gorilla) can be used to generate the adenoviral vector. For example, the adenoviral vector can be based on a simian adenovirus, including both new world and old world monkeys (see, e.g., *Virus Taxonomy: VIIIth Report of the International Committee on Taxonomy of Viruses* (2005)). The phylogeny of adenoviruses that infect primates is disclosed in, e.g., Roy et al., *PLoS Pathog.*, 5(7): e100050. doi:10.1371/journal.ppat.1000503 (2009). For instance, a simian adenovirus can be of serotype 1, 3, 6, 7, 11, 16, 18, 19, 20, 27, 33, 38, 39, 48, 49, or 50, or any other simian adenoviral serotype. Other non-human adenoviruses which can be used in the invention include non-human primate adenoviruses that are genetically and/or phenotypically similar to or distinct from group C human adenoviruses.

A gorilla adenovirus can be used as the source of the adenoviral genome for the adenoviral vector. There are four widely recognized gorilla subspecies within the two species of Eastern Gorilla (*Gorilla beringei*) and Western Gorilla (*Gorilla gorilla*). The Western Gorilla species includes the subspecies Western Lowland Gorilla (*Gorilla gorilla gorilla*) and Cross River Gorilla (*Gorilla gorilla diehli*). The Eastern Gorilla species includes the subspecies Mountain Gorilla (*Gorilla beringei beringei*) and Eastern Lowland Gorilla (*Gorilla beringei graueri*) (see, e.g., Wilson and Reeder, eds., *Mammalian Species of the World,* 3rd ed., Johns Hopkins University Press, Baltimore, Md. (2005)). The adenoviral vector can be based on an adenovirus isolated from any of the aforementioned subspecies. Preferably, the adenoviral vector is based on an adenovirus isolated from Mountain Gorilla (*Gorilla beringei beringei*) or Eastern Lowland Gorilla (*Gorilla beringei graueri*).

Gorilla adenovirus used as the source of the adenoviral genome can have a nucleic acid sequence that is at least 70% (e.g., at least 75%, at least 80%, at least 85%, at least 90%, at least 95%, at least 96%, at least 97%, at least 98%, at least 99%, or 100%) identical to the nucleic acid sequence of, for example, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, or SEQ ID NO: 28. In particular, the inventive nucleic acid sequence(s) encoding one or more HSV antigens and/or other antigens and/or adjuvants can be inserted into an adenoviral vector described in U.S. Patent Application Nos. 61/543,638, 61/543,652, and 61/543,661.

A human adenovirus can be used as the source of the viral genome for the adenoviral vector. For instance, an adenovirus can be of subgroup A (e.g., serotypes 12, 18, and 31), subgroup B (e.g., serotypes 3, 7, 11, 14, 16, 21, 34, 35, and 50), subgroup C (e.g., serotypes 1, 2, 5, and 6), subgroup D (e.g., serotypes 8, 9, 10, 13, 15, 17, 19, 20, 22-30, 32, 33, 36-39, and 42-48), subgroup E (e.g., serotype 4), subgroup F (e.g., serotypes 40 and 41), an unclassified serogroup (e.g., serotypes 49 and 51), or any other adenoviral serogroup or serotype. Adenoviral serotypes 1 through 51 (i.e., Ad1 through Ad51) are available from the American Type Culture Collection (ATCC, Manassas, Va.). Non-group C adenoviral vectors, methods of producing non-group C adenoviral vectors, and methods of using non-group C adenoviral vectors are disclosed in, for example, U.S. Pat. Nos. 5,801,030, 5,837,511, and 5,849,561, and International Patent Application Publications WO 1997/012986 and WO 1998/053087.

The adenoviral vector can comprise a composition of subtypes and thereby be a "chimeric" adenoviral vector. A chimeric adenoviral vector can comprise an adenoviral genome that is derived from two or more (e.g., 2, 3, 4, etc.) different adenovirus serotypes. In the context of the invention, a chimeric adenoviral vector can comprise approximately different or equal amounts of the genome of each of the two or more different adenovirus serotypes. For example, when the chimeric adenoviral vector genome is comprised of the genomes of two different adenovirus serotypes, the chimeric adenoviral vector genome preferably comprises no more than about 99% (e.g., no more than about 95%, no more than about 85%, no more than about 80%, no more than about 75%, no more than about 60%, no more than about 65%, or no more than about 50%) of the genome of one of the adenovirus serotypes, with the remainder of the chimeric adenovirus genome being derived from the genome of the other adenovirus serotype.

In one embodiment, the invention provides a serotype 28 adenovector (Ad28) that contains the hexon and/or fiber (e.g., knob) from a different serotype (e.g., a low seroprevalence human adenoviral vector, such as human serotype 45 adenovirus). A description of the viral genome of such a modified Ad28 vector is set forth in Example 1.

The adenoviral vector for use in the invention can be replication-competent, conditionally-replicating, or replication-deficient. Preferably, the adenovirus or adenoviral vector is replication-deficient, such that the replication-deficient adenovirus or adenoviral vector requires complementation of at least one replication-essential gene function of one or more regions of the adenoviral genome for propagation (e.g., to form adenoviral vector particles).

The replication-deficient adenovirus or adenoviral vector can be modified in any suitable manner to cause the deficiencies in the one or more replication-essential gene functions in one or more regions of the adenoviral genome for propagation. The complementation of the deficiencies in the one or more replication-essential gene functions of one or more regions of the adenoviral genome refers to the use of exogenous means to provide the deficient replication-essential gene functions. Such complementation can be effected in any suitable manner, for example, by using complementing cells and/or exogenous DNA (e.g., helper adenovirus) encoding the disrupted replication-essential gene functions.

A deficiency in a gene function or genomic region, as used herein, is defined as a disruption (e.g., deletion) of sufficient genetic material of the adenoviral genome to obliterate or impair the function of the gene (e.g., such that the function of the gene product is reduced by at least about 2-fold, 5-fold, 10-fold, 20-fold, 30-fold, or 50-fold) whose nucleic acid sequence was disrupted (e.g., deleted) in whole or in part. Deletion of an entire gene region often is not required for disruption of a replication-essential gene function. However, for the purpose of providing sufficient space in the adenoviral genome for one or more transgenes, removal of a majority of one or more gene regions may be desirable. While deletion of genetic material is preferred, mutation of genetic material by addition or substitution also is appropriate for disrupting gene function. Replication-essential gene functions are those gene functions that are required for adenovirus replication (e.g., propagation) and are encoded by, for example, the adenoviral early regions (e.g., the E1, E2, and E4 regions), late regions (e.g., the L1, L2, L3, L4, and L5 regions), genes involved in viral packaging (e.g., the IVa2 gene), and virus-associated RNAs (e.g., VA-RNA-1 and/or VA-RNA-2).

The adenovirus or adenoviral vector can be deficient in one or more replication-essential gene functions of only the early regions (i.e., E1-E4 regions) of the adenoviral genome, only the late regions (i.e., L1-L5 regions) of the adenoviral genome, both the early and late regions of the adenoviral genome, or all adenoviral genes (i.e., a high capacity adenovector (HC-Ad). See Morsy et al., *Proc. Natl. Acad. Sci. USA*, 95: 965-976 (1998); Chen et al., *Proc. Natl. Acad. Sci. USA*, 94: 1645-1650 (1997); and Kochanek et al., *Hum. Gene Ther.*, 10: 2451-2459 (1999). Examples of replication-deficient adenoviral vectors are disclosed in U.S. Pat. Nos. 5,837,511; 5,851,806; 5,994,106; 6,127,175; 6,482,616; and 7,195,896, and International Patent Application Publications WO 1994/028152, WO 1995/002697, WO 1995/016772, WO 1995/034671, WO 1996/022378, WO 1997/012986, WO 1997/021826, and WO 2003/022311.

The early regions of the adenoviral genome include the E1, E2, E3, and E4 regions. The late regions of the adenoviral genome include the L1, L2, L3, L4, and L5 regions. The adenovirus or adenoviral vector also can have a mutation in the major late promoter (MLP), as discussed in International Patent Application Publication WO 2000/000628, which can render the adenovirus or adenoviral vector replication-deficient if desired.

The E1 region comprises the E1A and E1B subregions, and one or more deficiencies in replication-essential gene functions in the E1 region can include one or more deficiencies in replication-essential gene functions in either or both of the E1A and E1B subregions, thereby requiring complementation of the deficiency in the E1A subregion and/or the E1B subregion of the adenoviral genome for the adenovirus or adenoviral vector to propagate (e.g., to form adenoviral vector particles).

The E2 region comprises the E2A and E2B subregions, and one or more deficiencies in replication-essential gene functions in the E2 region can include one or more deficiencies in replication-essential gene functions in either or both of the E2A and E2B subregions, thereby requiring complementation of the deficiency in the E2A subregion and/or the E2B subregion of the adenoviral genome for the adenovirus or adenoviral vector to propagate (e.g., to form adenoviral vector particles).

The E3 region does not include any replication-essential gene functions, such that a deletion of the E3 region in part or in whole does not require complementation of any gene functions in the E3 region for the adenovirus or adenoviral vector to propagate (e.g., to form adenoviral vector particles). In the context of the invention, the E3 region is defined as the region that initiates with the open reading frame that encodes a protein with high homology to the 12.5K protein from the E3 region of human adenovirus 5 (NCBI reference sequence AP_000218) and ends with the open reading frame that encodes a protein with high homology to the 14.7K protein from the E3 region of human adenovirus 5 (NCBI reference sequence AP_000224.1). The E3 region may be deleted in whole or in part, or retained in whole or in part. The size of the deletion may be tailored so as to retain an adenovirus or adenoviral vector whose genome closely matches the optimum genome packaging size. A larger deletion will accommodate the insertion of larger heterologous nucleic acid sequences in the adenovirus or adenoviral genome. In one embodiment of the invention, the L4 polyadenylation signal sequences, which reside in the E3 region, are retained.

The E4 region comprises multiple open reading frames (ORFs). An adenovirus or adenoviral vector with a deletion of all of the open reading frames of the E4 region except ORF6, and in some cases ORF3, does not require complementation of any gene functions in the E4 region for the adenovirus or adenoviral vector to propagate (e.g., to form adenoviral vector particles). Conversely, an adenovirus or adenoviral vector with a disruption or deletion of ORF6, and in some cases ORF3, of the E4 region (e.g., with a deficiency in a replication-essential gene function based in ORF6 and/or ORF3 of the E4 region), with or without a disruption or deletion of any of the other open reading frames of the E4 region or the native E4 promoter, polyadenylation sequence, and/or the right-side inverted terminal repeat (ITR), requires complementation of the deficiency in the E4 region (specifically, of ORF6 and/or ORF3 of the E4 region) for the adenovirus or adenoviral vector to propagate (e.g., to form adenoviral vector particles).

The one or more regions of the adenoviral genome that contain one or more deficiencies in replication-essential gene functions desirably are one or more early regions of the adenoviral genome, i.e., the E1, E2, and/or E4 regions, optionally with the deletion in part or in whole of the E3 region. In other words, the adenoviral vector requires, at most, complementation of a deficiency in one or more early regions of the adenoviral genome for propagation.

The replication-deficient adenovirus or adenoviral vector also can have one or more mutations as compared to the wild-type adenovirus (e.g., one or more deletions, insertions, and/or substitutions) in the adenoviral genome that do not inhibit viral replication in host cells. Thus, in addition to one or more deficiencies in replication-essential gene functions, the adenovirus or adenoviral vector can be deficient in other respects that are not replication-essential. For example, the adenovirus or adenoviral vector can have a partial or entire deletion of the adenoviral early region known as the E3 region, which is not essential for propagation of the adenovirus or adenoviral genome.

In one embodiment, the adenovirus or adenoviral vector is replication-deficient and requires, at most, complementation of the E1 region or the E4 region of the adenoviral genome, for propagation (e.g., to form adenoviral vector particles). Thus, the replication-deficient adenovirus or adenoviral vector requires complementation of at least one replication-essential gene function of the E1A subregion and/or the E1B region of the adenoviral genome (denoted an E1-deficient adenoviral vector) or the E4 region of the adenoviral genome (denoted an E4-deficient adenoviral vector) for propagation (e.g., to form adenoviral vector particles). The adenovirus or adenoviral vector can be deficient in at least one replication-essential gene function (desirably all replication-essential gene functions) of the E1 region of the adenoviral genome and at least one gene function of the nonessential E3 region of the adenoviral genome (denoted an E1/E3-deficient adenoviral vector). Such an adenoviral vector requires, at most, complementation of a deficiency in the E1 region of the adenoviral genome for propagation. The adenovirus or adenoviral vector can be deficient in at least one replication-essential gene function (desirably all replication-essential gene functions) of the E4 region of the adenoviral genome and at least one gene function of the nonessential E3 region of the adenoviral genome (denoted an E3/E4-deficient adenoviral vector). Such an adenoviral vector requires, at most, complementation of a deficiency in the E4 region of the adenoviral genome for propagation.

In one embodiment, the adenovirus or adenoviral vector is replication-deficient and requires, at most, complementation of the E2 region, preferably the E2A subregion, of the adenoviral genome, for propagation (e.g., to form adenoviral vector particles). Thus, the replication-deficient adenovirus or adenoviral vector requires complementation of at least one replication-essential gene function of the E2A subregion of the adenoviral genome (denoted an E2A-deficient adenoviral vector) for propagation (e.g., to form adenoviral vector particles). The adenovirus or adenoviral vector can be deficient in at least one replication-essential gene function (desirably all replication-essential gene functions) of the E2A region of the adenoviral genome and at least one gene function of the nonessential E3 region of the adenoviral genome (denoted an E2A/E3-deficient adenoviral vector). Such an adenoviral vector requires, at most, complementation of a deficiency in the E2A region of the adenoviral genome for propagation.

In one embodiment, the adenovirus or adenoviral vector requires complementation of the E1 and E2 (e.g., E2A) regions of the adenoviral genome for complementation (denoted an E1/E2-deficient adenoviral vector), wherein the adenovirus or adenoviral vector also can be deficient in at least one gene function of the E3 region (denoted an E1/E2/E3-deficient adenoviral vector). Such an adenoviral vector requires, at most, complementation of a deficiency in the E1 region and a deficiency in the E2 region of the adenoviral genome for propagation.

In one embodiment, the adenovirus or adenoviral vector is replication-deficient and requires, at most, complementation of the E1 and E4 regions of the adenoviral genome for propagation (e.g., to form adenoviral vector particles). Thus, the replication-deficient adenovirus or adenoviral vector requires complementation of at least one replication-essential gene function of both the E1 and E4 regions of the adenoviral genome (denoted an E1/E4-deficient adenoviral vector) for propagation (e.g., to form adenoviral vector particles). The adenovirus or adenoviral vector can be deficient in at least one replication-essential gene function (desirably all replication-essential gene functions) of the E1 region of the adenoviral genome, at least one replication-essential gene function of the E4 region of the adenoviral genome, and at least one gene function of the nonessential E3 region of the adenoviral genome (denoted an E1/E3/E4-deficient adenoviral vector).

In a preferred embodiment, the adenovirus or adenoviral vector requires, at most, complementation of a deficiency in the E1 region of the adenoviral genome for propagation, and does not require complementation of any other deficiency of the adenoviral genome for propagation. In another preferred embodiment, the adenovirus or adenoviral vector requires, at most, complementation of a deficiency in both the E1 and E4 regions of the adenoviral genome for propagation, and does not require complementation of any other deficiency of the adenoviral genome for propagation.

The adenovirus or adenoviral vector, when deficient in multiple replication-essential gene functions of the adenoviral genome (e.g., an E1/E4-deficient adenoviral vector), can include a spacer sequence to provide viral growth in a complementing cell line similar to that achieved by adenoviruses or adenoviral vectors deficient in a single replication-essential gene function (e.g., an E1-deficient adenoviral vector). The spacer sequence can contain any nucleotide sequence or sequences which are of a desired length, such as sequences at least about 15 base pairs (e.g., between about 15 nucleotides and about 12,000 nucleotides), preferably about 100 nucleotides to about 10,000 nucleotides, more preferably about 500 nucleotides to about 8,000 nucleotides, even more preferably about 1,500 nucleotides to about 6,000 nucleotides, and most preferably about 2,000 to about 3,000 nucleotides in length, or a range defined by any two of the foregoing values. The spacer sequence can be coding or non-coding and native or non-native with respect to the adenoviral genome, but does not restore the replication-essential function to the deficient region. The spacer also can contain an expression cassette. More preferably, the spacer comprises a polyadenylation sequence and/or a gene that is non-native with respect to the adenovirus or adenoviral vector. The use of a spacer in an adenoviral vector is further described in, for example, U.S. Pat. No. 5,851,806 and International Patent Application Publication WO 1997/021826.

By removing part of the adenoviral genome, for example, the E1, E3, and E4 regions of the adenoviral genome, the resulting adenovirus or adenoviral vector is able to accept inserts of exogenous nucleic acid sequences while retaining the ability to be packaged into adenoviral capsids. An exogenous nucleic acid sequence can be inserted at any position in the adenoviral genome so long as insertion in the position allows for the formation of adenovirus or the adenoviral vector particle. The exogenous nucleic acid sequence preferably is positioned in the E1 region, the E3 region, or the E4 region of the adenoviral genome.

The replication-deficient adenovirus or adenoviral vector of the invention can be produced in complementing cell lines that provide gene functions not present in the replication-deficient adenovirus or adenoviral vector, but required for viral propagation, at appropriate levels in order to generate high titers of viral vector stock. Such complementing cell lines are known and include, but are not limited to, 293 cells (described in, e.g., Graham et al., *J. Gen. Virol.*, 36: 59-72 (1977)), PER.C6 cells (described in, e.g., International Patent Application Publication WO 1997/000326, and U.S. Pat. Nos. 5,994,128 and 6,033,908), and 293-ORF6 cells (described in, e.g., International Patent Application Publication WO 1995/034671 and Brough et al., *J. Virol.*, 71: 9206-9213 (1997)). Other suitable complementing cell lines to produce the replication-deficient adenovirus or adenoviral vector of the invention include complementing cells that have been generated to propagate adenoviral vectors encoding transgenes whose expression inhibits viral growth in host cells (see, e.g., U.S. Patent Application Publication No. 2008/0233650). Additional suitable complementing cells are described in, for example, U.S. Pat. Nos. 6,677,156 and 6,682,929, U.S. Patent Application Publication No. 2008/0233650 A1, and International Patent Application Publication WO 2003/020879. In some instances, the cellular genome need not comprise nucleic acid sequences, the gene products of which complement for all of the deficiencies of a replication-deficient adenoviral vector. One or more replication-essential gene functions lacking in a replication-deficient adenoviral vector can be supplied by a helper virus, e.g., an adenoviral vector that supplies in trans one or more essential gene functions required for replication of the replication-deficient adenovirus or adenoviral vector. Alternatively, the inventive adenovirus or adenoviral vector can comprise a non-native replication-essential gene that complements for the one or more replication-essential gene functions lacking in the inventive replication-deficient adenovirus or adenoviral vector. For example, an E1/E4-deficient adenoviral vector can be engineered to contain a nucleic acid sequence encoding E4 ORF 6 that is obtained or derived from a different adenovirus (e.g., an adenovirus of a different serotype than the inventive adenovirus or adenoviral vector, or an adenovirus of a different species than the inventive adenovirus or adenoviral vector).

In addition to the nucleic acid encoding the one or more HSV antigens, the vector also can comprise gene(s) encoding one or more immunostimulatory/regulatory molecules, cytokines, or other molecules that can enhance an immune response to HSV. The nucleic acid, as well as any other exogenous gene(s), preferably are inserted into a site or region (insertion region) in the vector that does not affect virus viability of the resultant recombinant virus. Such regions can be readily identified by testing segments of virus DNA for regions that allow recombinant formation without seriously affecting virus viability of the recombinant virus.

The vector preferably also comprises expression control sequences, such as promoters, enhancers, polyadenylation signals, transcription terminators, internal ribosome entry sites (IRES), and the like, that provide for the expression of the nucleic acid sequence in a host cell. Exemplary expression control sequences are known in the art and are described in, for example, Goeddel, *Gene Expression Technology: Methods in Enzymology*, Vol. 185, Academic Press, San Diego, Calif. (1990). Ideally, the HSV antigen-encoding nucleic acid sequence is operably linked to a promoter and a polyadenylation sequence. A large number of promoters, including constitutive, inducible, and repressible promoters, from a variety of different sources are well known in the art. Representative sources of promoters include for example, virus, mammal, insect, plant, yeast, and bacteria, and suitable promoters from these sources are readily available, or can be made synthetically, based on sequences publicly available, for example, from depositories such as the ATCC as well as other commercial or individual sources. Promoters can be unidirectional (i.e., initiate transcription in one direction) or bi-directional (i.e., initiate transcription in either a 3' or 5' direction). Non-limiting examples of promoters include, for example, the T7 bacterial expression system, pBAD (araA) bacterial expression system, the cytomegalovirus (CMV) promoter, the SV40 promoter, and the RSV promoter. Inducible promoters include, for example, the Tet system (U.S. Pat. Nos. 5,464,758 and 5,814,618), the Ecdysone inducible system (No et al., *Proc. Natl. Acad. Sci.*, 93: 3346-3351 (1996)), the T-REx™ system (Invitrogen, Carlsbad, Calif.), LACSWITCH™ System (Stratagene, San Diego, Calif.), and the Cre-ERT tamoxifen inducible recombinase system (Indra et al., *Nuc. Acid. Res.*, 27: 4324-4327 (1999); *Nuc. Acid. Res.*, 28: e99 (2000); U.S. Pat. No. 7,112,715; and Kramer & Fussenegger, *Methods Mol. Biol.*, 308: 123-144 (2005)).

A promoter can be selected by matching its particular pattern of activity with the desired pattern and level of expression of an antigen(s) (e.g., the inventive or wild-type UL19 and/or UL47 antigens). For example, the vector can comprise two or more nucleic acid sequences that encode different antigens and are operably linked to different promoters displaying distinct expression profiles. In this regard, a first promoter can be selected to mediate an initial peak of antigen production, thereby priming the immune system against an encoded antigen. A second promoter can be selected to drive production of the same or different antigen such that expression peaks several days after that of the first promoter, thereby "boosting" the immune system against the antigen. Alternatively, a hybrid promoter can be constructed which combines the desirable aspects of multiple promoters. In that antigens can be toxic to eukaryotic cells, it may be advantageous to modify the promoter to decrease activity in complementing cell lines used to propagate the vector.

To optimize protein production, preferably the antigen-encoding nucleic acid sequence further comprises a polyadenylation site following the coding sequence. Any suitable polyadenylation sequence can be used, including a synthetic optimized sequence, as well as the polyadenylation sequence of BGH (bovine growth hormone), polyoma virus, TK (thymidine kinase), EBV (Epstein Barr virus), and the papillomaviruses, including HPV (human papillomavirus) and BPV (bovine papilloma virus). A preferred polyadenylation sequence is the SV40 (Human Sarcoma Virus-40) polyadenylation sequence. Also, preferably all the proper transcription signals (and translation signals, where appropriate) are correctly arranged such that the nucleic acid sequence is properly expressed in the cells into which it is introduced. If desired, the nucleic acid sequence also can incorporate splice sites (i.e., splice acceptor and splice donor sites) to facilitate mRNA production.

In one embodiment, the HSV antigen-encoding nucleic acid sequence further comprises the appropriate sequences for processing, secretion, intracellular localization, and the like. The HSV antigen-encoding nucleic acid sequence can be operably linked to a signal sequence, which targets a protein to cellular machinery for secretion. Appropriate signal sequences include, but are not limited to, leader sequences for immunoglobulin heavy chains and cytokines (see, for example, Ladunga et al., *Current Opinions in Biotechnology*, 11: 13-18 (2000)). Other protein modifications can be required to secrete a protein from a host cell, which can be determined using routine laboratory techniques. Preparing expression constructs encoding antigens and signal sequences is further described in, for example, U.S. Pat. No. 6,500,641. Methods of secreting non-secretable proteins are further described in, for example, U.S. Pat. No. 6,472,176 and International Patent Application Publication WO 2002/048377.

An HSV antigen encoded by the nucleic acid sequence of the vector also can be modified to attach or incorporate the antigen on a host cell surface. In this respect, the antigen can comprise a membrane anchor, such as a gpi-anchor, for conjugation onto a cell surface. A transmembrane domain can be fused to the antigen to incorporate a terminus of the antigen protein into the cell membrane. Other strategies for displaying peptides on a cell surface are known in the art and are appropriate for use in the context of the invention.

One or more of the inventive nucleic acid sequences, vectors, or polypeptides (alone or in further combination with other HSV antigens and/or other antigens), desirably in the form of a composition that includes a suitable carrier, can be administered to an animal, preferably a mammal, and most preferably a human. The human preferably is in a population that has a high risk of acquiring HSV or already has HSV.

Infection of an individual (e.g., human) with HSV can lead to HSV disease, wherein the infected individual demonstrates symptoms such as cold sores, itching or tingling sensations in the genital or anal area, small fluid-filled blisters that can burst leaving small painful sores (genital blisters), painful urination (due to the passing of urine over the open sores), headaches, backaches, and flu-like symptoms, including swollen glands or fever. While not wishing to be bound by any particular theory, the administration of the inventive nucleic acids, vectors, polypeptides, and compositions thereof leads to the treatment and/or prevention of HSV disease by reducing the presence of HSV virus and/or symptoms in an individual.

The invention provides a method of inducing an immune response against HSV in a mammal, a method of treating or preventing HSV disease in a mammal, a method of inducing a T cell response against HSV in a mammal, a method of reducing HSV viral shedding in a mammal, and a method of inducing an antibody response against HSV in a mammal. The HSV can be HSV-1 or HSV-2. The methods comprise administering to the mammal a composition comprising one or more of the inventive nucleic acid sequences or inventive vectors and a pharmaceutically acceptable carrier, whereupon the one or more nucleic acid sequences encoding the HSV antigen(s) and/or other antigens is expressed in the mammal to produce the one or more HSV antigens and/or other antigens and thereby induce an immune response against HSV in the mammal, treat or prevent HSV disease in the mammal, induce a T cell response against HSV in the mammal, and/or induce an antibody response against HSV in the mammal.

Alternatively, the methods comprise administering to the mammal a composition comprising the inventive UL47 polypeptide (alone or in further combination with the inventive and/or wild-type UL19 antigen and/or other antigens) and a pharmaceutically acceptable carrier to thereby induce an immune response against HSV in the mammal, treat or prevent HSV disease in the mammal, or induce a T cell response against HSV in the mammal, and/or induce an antibody response against HSV in the mammal.

The immune response can be a humoral immune response, a cell-mediated immune response, or a combination of humoral and cell-mediated immunity. Ideally, the immune response provides protection upon subsequent challenge with HSV. However, protective immunity is not required in the context of the invention. The inventive method also can be used for antibody production.

The invention provides a composition comprising (a) one or more of the inventive nucleic acid sequences, one or more of the inventive vectors, or one or more of the inventive polypeptides (alone or in further combination with other HSV antigens and/or other antigens) and (b) a carrier (e.g., a pharmaceutically acceptable carrier). The composition desirably is a physiologically acceptable (e.g., pharmaceutically acceptable) composition, which comprises a carrier, preferably a physiologically (e.g., pharmaceutically) acceptable carrier, and one or more of the inventive nucleic acid sequences, vectors, or polypeptides (alone or in further combination with other HSV antigens and/or other antigens). Any suitable carrier can be used within the context of the invention, and such carriers are well known in the art. The choice of carrier will be determined, in part, by the particular use of the composition, e.g., administration to an animal and the particular method used to administer the composition to the animal. The composition optionally can be sterile. Ideally, in embodiments in which the vector is a replication-deficient adenoviral vector, the composition preferably is free of replication-competent adenovirus (RCA) contamination (e.g., the composition comprises less than about 1% of replication-competent adenovirus on the basis of the total adenoviruses in the composition). Most desirably, such a composition is RCA-free. Adenoviral vector compositions and stocks that are RCA-free are described in U.S. Pat. No. 5,944,106 and International Patent Application Publication WO 1995/034671.

To enhance the immune response generated against an HSV antigen, an immune stimulator, or a nucleic acid sequence that encodes an immune stimulator, also can be administered to the mammal (e.g., as a component of the inventive compositions). Immune stimulators also are referred to in the art as "adjuvants," and include, for example, cytokines, chemokines, or chaperones. Cytokines include, for example, Macrophage Colony Stimulating Factor (e.g., GM-CSF), Interferon Alpha (IFN-α), Interferon Beta (IFN-β), Interferon Gamma (IFN-γ), interleukins (IL-1, IL-2, IL-4, IL-5, IL-6, IL-7, IL-8, IL-10, IL-12, IL-13, IL-15, IL-16, and IL-18), the tumor necrosis factor (TNF) family of proteins, Intercellular Adhesion Molecule-1 (ICAM-1), Lymphocyte Function-Associated antigen-3 (LFA-3), B7-1, B7-2, FMS-related tyrosine kinase 3 ligand, (Flt3L), vasoactive intestinal peptide (VIP), LIGHT (also known as TNFSFI4 or HVEM-L), and CD40 ligand. Chemokines include, for example, B Cell-Attracting chemokine-1 (BCA-1), Fractalkine, Melanoma Growth Stimulatory Activity protein (MGSA), Hemofiltrate CC chemokine 1 (HCC-1), Interleukin 8 (IL-8), Interferon-stimulated T cell alpha chemoattractant (I-TAC), Lymphotactin, Monocyte Chemotactic Protein 1 (MCP-1), Monocyte Chemotactic Protein 3 (MCP-3), Monocyte Chemotactic Protein 4 (CP-4), Macrophage-Derived Chemokine (MDC), a macrophage inflammatory protein (MIP), Platelet Factor 4 (PF4), Regulated on Activation Normal T Cell Expressed and Secreted Chemokine (RANTES), Breast and Kidney-Expressed Chemokine (BRAK), eotaxin, exodus 1-3, and the like. Chaperones include, for example, the heat shock proteins Hsp70, Hsc70, and Hsp40.

The composition also can comprise other antiviral drugs, such as nucleoside analogs, peptide analogs, and small molecules that target viral transcription, translation, entry, and/or coating. For example, the composition can comprise acyclovir, foscarnet, ribavirin, interferons, or any combination thereof.

Suitable formulations for the composition include aqueous and non-aqueous solutions, isotonic sterile solutions, which can contain anti-oxidants, buffers, and bacteriostats, and aqueous and non-aqueous sterile suspensions that can include suspending agents, solubilizers, thickening agents, stabilizers, and preservatives. The formulations can be presented in unit-dose or multi-dose sealed containers, such as ampules and vials, and can be stored in a freeze-dried (lyophilized) condition requiring only the addition of the sterile liquid carrier, for example, water, immediately prior to use. Extemporaneous solutions and suspensions can be prepared from sterile powders, granules, and tablets. Preferably, the carrier is a buffered saline solution. If the vector is an adenoviral vector, then the composition preferably is formulated to protect the adenoviral vector from damage prior to administration. For example, the composition can be formulated to reduce loss of the adenoviral vector on devices used to prepare, store, or administer the adenoviral vector, such as glassware, syringes, or needles. The composition can be formulated to decrease the light sensitivity and/or temperature sensitivity of the adenoviral vector. To this end, the composition preferably comprises a pharmaceutically acceptable liquid carrier, such as, for example, those described above, and a stabilizing agent selected from the group consisting of polysorbate 80, L-arginine, polyvinylpyrrolidone, trehalose, and combinations thereof. Use of such a composition will extend the shelf life of the vector, facilitate administration, and increase the efficiency of the inventive method. Formulations for adenoviral vector-containing compositions are further described in, for example, U.S. Pat. No. 6,225,289, U.S. Pat. No. 6,514,943, and International Patent Application Publication WO 2000/034444.

The composition also can be formulated to enhance transduction efficiency. In addition, the vector can be present in a composition with other therapeutic or biologically-active agents. For example, factors that control inflammation, such as ibuprofen or steroids, can be part of the composition to reduce swelling and inflammation associated with in vivo administration of the vector. As discussed herein, immune system stimulators or adjuvants, e.g., interleukins, lipopolysaccharide, or double-stranded RNA, can be administered to enhance or modify any immune response to the HSV antigen. Antibiotics, i.e., microbicides and fungicides, can be present to treat existing infection and/or reduce the risk of future infection, such as infection associated with gene transfer procedures.

Any route of administration can be used to deliver the composition to the mammal. Indeed, although more than one route can be used to administer the composition, a particular route can provide a more immediate and more effective reaction than another route. Preferably, the composition is administered via intramuscular injection or intradermal, subcutaneous, oral, colorectal, or intranasal administration. The composition also can be applied or instilled into body cavities (e.g., intravaginal), absorbed through the skin (e.g., via a transdermal patch), inhaled, ingested, topically applied to tissue, or administered parenterally via, for instance, intravenous, peritoneal, or intraarterial administration. For example, when parenteral administration is employed, the composition can be administered in the arm (e.g., upper arm), buttocks, thigh, and/or face (e.g., in and around the lips). The administration can be via standard injection devices (e.g., needle and syringe), via a mechanical device or device using electricity, heat, cold, beads, or magnetic waves, and/or via micro needles or dissolving maltose-based needles (see, e.g., Eisenstein M., *Nature Biotechnology*, 29(2): 107-109 (2011).

The composition can be administered in or on a device that allows controlled or sustained release, such as a sponge, biocompatible meshwork, mechanical reservoir, or mechanical implant. Implants (see, e.g., U.S. Pat. No. 5,443,505), devices (see, e.g., U.S. Pat. No. 4,863,457), such as an implantable device, e.g., a mechanical reservoir or an implant or a device comprised of a polymeric composition, are particularly useful for administration of the composition. The composition also can be administered in the form of sustained-release formulations (see, e.g., U.S. Pat. No. 5,378,475) comprising, for example, gel foam, hyaluronic acid, gelatin, chondroitin sulfate, a polyphosphoester, such as bis-2-hydroxyethyl-terephthalate (BHET), and/or a poly-lactic-glycolic acid.

The dose of the inventive nucleic acids, inventive vectors, and/or wild-type or inventive polypeptides as described herein administered to the mammal will depend on a number of factors, including the extent of any side-effects, the particular route of administration, and the like. The dose ideally comprises an "effective amount" of the inventive nucleic acids, inventive vectors, and/or wild-type or inventive polypeptides as described herein. For example, the dose of an inventive vector desirably is a dose of vector which provokes a desired immune response in the mammal. A single dose of vector (e.g., adenoviral vector) desirably comprises at least about $1\times10^5$ particles (which also is referred to as particle units) of vector. The dose preferably is at least about $1\times10^6$ particles (e.g., about $1\times10^6$-$1\times10^{12}$ particles), more preferably at least about $1\times10^7$ particles, more preferably at least about $1\times10^8$ particles (e.g., about $1\times10^8$-$1\times10^{11}$ particles or about $1\times10^8$-$1\times10^{12}$ particles), and most preferably at least about $1\times10^9$ particles (e.g., about $1\times10^9$-$1\times10^{10}$ particles or about $1\times10^9$-$1\times10^{12}$ particles), or even at least about $1\times10^{10}$ particles (e.g., about $1\times10^{10}$-$1\times10^{12}$ particles) of the vector. The dose desirably comprises no more than about $1\times10^{14}$ particles, preferably no more than about $1\times10^{13}$ particles, even more preferably no more than about $1\times10^{12}$ particles, even more preferably no more than about $1\times10^{11}$ particles, and most preferably no more than about $1\times10^{10}$ particles of the vector. In other words, a single dose of the vector (especially adenoviral vector) can comprise, for example, about $1\times10^6$ particle units (PU), $2\times10^6$ PU, $4\times10^6$ PU, $1\times10^7$ PU, $2\times10^7$ PU, $4\times10^7$ PU, $1\times10^8$ PU, $2\times10^8$ PU, $4\times10^8$ PU, $1\times10^9$ PU, $2\times10^9$ PU, $4\times10^9$ PU, $1\times10^{10}$ PU, $2\times10^{10}$ PU, $4\times10^{10}$ PU, $1\times10^{11}$ PU, $2\times10^{11}$ PU, $4\times10^{11}$ PU, $1\times10^{12}$ PU, $2\times10^{12}$ PU, or $4\times10^{12}$ PU of the vector.

Administration of the composition containing the inventive vector can be one component of a multistep regimen for inducing an immune response against HSV in a mammal, treating or preventing HSV disease in the mammal, inducing a T cell response against HSV in the mammal, and/or inducing an antibody response against HSV in the mammal. In this respect, the method further comprises administering to the mammal a boosting composition after administering the vector to the mammal. In this embodiment, therefore, the immune response is "primed" upon administration of the composition containing the first vector (or composition of multiple vectors), and is "boosted" upon administration of the boosting composition. Alternatively, the inventive method further comprises administering to the mammal a priming composition to the mammal prior to administering the vector to the mammal. In this embodiment, therefore, the immune response is "primed" upon administration of the priming composition, and is "boosted" upon administration of the composition containing the vector. The inventive method can comprise multiple administrations of the same entity or different entities (e.g., two, three, four, five, or six times or more).

Each of the priming composition and the boosting composition desirably comprises one or more vectors that comprise a nucleic acid sequence encoding one or more HSV antigens. Any suitable vector can be employed, including viral and non-viral vectors, as described herein. Examples of suitable viral vectors include, but are not limited to, retroviral vectors, adeno-associated virus vectors, vaccinia virus vectors, herpesvirus vectors, parainfluenza-RSV chimeric vectors (PIV-RSV), and adenoviral vectors. Examples of suitable non-viral vectors include, but are not limited to, plasmids, liposomes, nanoparticles, and molecular conjugates (e.g., transferrin). Preferably, the priming composition or the boosting composition is a plasmid or an adenoviral vector. Alternatively, an immune response can be primed or boosted by administration of an HSV protein itself (e.g., an antigenic HSV protein) with or without a suitable adjuvant (e.g., alum, QS-21, insulin-derived adjuvant, etc.), a live-attenuated HSV particle, a virus-like particle, and the like. When the priming composition and/or the boosting composition is an adenoviral vector, it can be an adenoviral vector derived from any human or non-human animal as described herein.

The priming and boosting compositions can be the same or different. When the priming and the boosting compositions are the same, the compositions are deemed "homologous." When the priming and the boosting compositions are different, the compositions are deemed "heterologous."

In one embodiment, the vectors used in the priming and boosting compositions can comprise any combination of the following, wherein the priming and boosting compositions can be the same or different: human serotype 28 adenoviral (Ad28) vectors, Ad28 vectors with hexon from a different adenoviral serotype (Ad28 H), Ad28 with hexon and fiber (e.g., knob) from a different adenoviral serotype (Ad28 H/F), human serotype 5 adenoviral (Ad5) vectors, Ad5 with hexon from a different adenoviral serotype (Ad5 H), Ad5 with hexon and fiber from a different adenoviral serotype (Ad5 H/F), and other adenoviral vectors (e.g., gorilla adenoviral vectors) as described herein.

In a preferred embodiment, the priming composition and/or the boosting composition comprises a human adenoviral vector (e.g., serotype 5, 28, or 35) or another adenoviral vector, including but not limited to other species. For example, a priming composition containing a human serotype 28 adenoviral vector can be administered to a human, followed by administration of a boosting composition containing another adenoviral vector (e.g., adenoviral vector isolated from gorilla). Alternatively, a priming composition containing a human serotype 28 adenoviral vector can be administered to a human, followed by administration of a boosting composition containing a modified human serotype 28 adenoviral vector comprising hexon and/or fiber (e.g., knob) from a different serotype (e.g., serotype 45) adenoviral vector. In another embodiment, a priming composition containing another species of adenoviral vector (e.g., adenoviral vector isolated from gorilla) can be administered to a human, followed by a second administration of the same composition. The invention encompasses the use of any combination of human (e.g., Ad28, Ad28 H, Ad28 H/F, Ad5, Ad5 H, and/or Ad5 H/F) and/or other adenoviral vectors (e.g., adenoviral vectors isolated from gorilla) encoding one or more HSV antigens and/or other antigens in the priming or boosting composition.

When two or more administrations are employed for the prime/boost, the vectors of the priming composition and the boosting composition(s) (which vectors can be the same or different) desirably comprise the same exogenous nucleic acid sequence(s) (e.g., at least one nucleic acid sequence encoding the same HSV antigen or multiple (i.e., two or more) nucleic acid sequences encoding the same HSV antigen or antigens). In another embodiment, the vectors of the priming composition and/or the boosting composition(s) (which vectors can be the same or different) can comprise different exogenous nucleic acid sequences encoding one, two, or more different HSV antigens. The priming and/or boosting composition(s) also can contain one or more cytokines or adjuvants.

Administration of the priming composition and the boosting composition can be separated by any suitable timeframe (e.g., at least about 1 week, 2 weeks, 3 weeks, 4 weeks, 8 weeks, 12 weeks, 16 weeks, 24 weeks, 52 weeks, or a range defined by any two of the foregoing values). The boosting composition preferably is administered to a mammal (e.g., human) at least about 1 week (e.g., 2 weeks, 3 weeks, 4 weeks, 5 weeks, 6 weeks, 7 weeks, 8 weeks, 9 weeks, 10 weeks, 11 weeks, 12 weeks, 13 weeks, 14 weeks, 15 weeks, 16 weeks, 20 weeks, 24 weeks, 28 weeks, 35 weeks, 40 weeks, 50 weeks, 52 weeks, or a range defined by any two of the foregoing values) following administration of the priming composition. More than one dose of priming composition and/or boosting composition can be provided in any suitable timeframe. The dose of the priming composition and boosting composition administered to the mammal depends on a number of factors, including the extent of any side-effects, the particular route of administration, and the like.

In preferred embodiments, the invention provides a method of inducing an immune response against HSV in a mammal, a method of treating or preventing HSV disease in a mammal, a method of inducing a T cell response against HSV in a mammal, and a method of inducing an antibody response against HSV in a mammal, which method comprises (a) administering to the mammal a priming composition comprising one or more replication-deficient adenoviral vectors comprising (i) one or more of the inventive nucleic acid sequences and/or (ii) one or more nucleic acid sequences comprising the wild-type UL19 and/or UL47 sequence(s) and a pharmaceutically acceptable carrier, and (b) administering to the mammal a boosting composition comprising (i) one or more of the inventive nucleic acid sequences and/or (ii) one or more nucleic acid sequences comprising the wild-type UL19 and/or UL47 sequence(s) and a pharmaceutically acceptable carrier. The administration of the priming composition and the boosting composition can be separated by any suitable length of time as described herein, but preferably is at least about 1 week. The administration of the initial administration and subsequent administrations can be separated by any suitable length of time as described herein, but preferably is at least about 1 week apart. The administration of the boosting composition, or subsequent administrations, desirably induces an enhanced immune response (e.g. T cell response), as compared to the immune response induced after the administration of the priming composition, or initial administration, alone.

The inventive methods also can include the simultaneous, subsequent, and/or sequential administration of other antiviral drugs, such as nucleoside analogs, peptide analogs, and small molecules that target viral transcription, translation, entry, and/or coating, such as acyclovir, foscarnet, ribavirin, interferons, or any combination thereof.

The following examples further illustrate the invention but, of course, should not be construed as in any way limiting its scope.

EXAMPLE 1

This example demonstrates the construction of an adenovirus comprising the inventive nucleic acid sequence encoding an HSV antigen.

A human serotype 28 adenoviral vector was prepared with a deletion in the E1 region, the replacement of the hexon region with the hexon region of a human serotype 45 adenovirus, and the insertion of the nucleic acid sequence comprising SEQ ID NO: 5 (Ad28UL19 H(Ad45)). Ad28UL19 H(Ad45) is replication-deficient due to the deletion of the essential function provided by E1. The CMV promoter and transgene expression cassette comprising SEQ ID NO: 5 were introduced in place of the E1 sequences. The expression cassette, located at the E1 region deletion junction, is right-to-left with respect to the viral genome.

Ad28UL19 H(Ad45) has an E1 region deletion of bases 462 through 3111 of the Ad28 genomic sequence. The deletion includes Ad28E1A and part of the E1B early proteins, which renders the vector replication incompetent in noncomplementing cell lines.

A description of the vector construction is as follows. The plasmid pAC28E1(t.UL19)H(45) was constructed that encodes the entire Ad28UL19H(Ad45) adenoviral vector genome with the CMV.UL19 expression cassette in the E1 region and the Ad45 hexon in place of the Ad28 hexon. A single genetic clone of the final vector genome was achieved by two sequential colony-growth steps in bacteria. This viral vector genome encoded by the plasmid was converted to a viral vector upon introduction into mammalian cells that complement for adenoviral vector growth. Subsequent expansion via serial passaging was performed to generate adenoviral vector stocks.

A similar method was used to incorporate the Ad45 fiber (shaft with knob) domain in place of the Ad28 fiber. This entire method was repeated for other HSV2 antigens cloned into the adenoviral vector base, Ad28.

EXAMPLE 2

This example describes animal models for the evaluation of antiviral efficacy.

Mouse Model of Primary HSV-1/HSV-2 Challenge:

The primary screening model provides a rapid initial evaluation of antiviral efficacy against HSV primary infection with both clinical and virological endpoints. This model utilizes intravaginal inoculation of female mice (25 g) with HSV-1 or HSV-2 to evaluate potential antiviral therapies as well as vaccine/adjuvant candidates. Animals are followed daily for signs and systems of herpes disease, and vaginal swabs are obtained to evaluate the effect of therapy on viral replication. Single or combined antiviral therapies can be administered by any suitable means, including, but not limited to, topically, orally or systemically, and can be given at varying intervals begun before or after viral challenge. Dose range studies also can be carried out.

Dose and route of administration are individualized for each experimental agent. However, for each intravaginal dose, 15-30 µl of product typically is required. Treatment group size is typically 12-16 mice.

Figure 7:
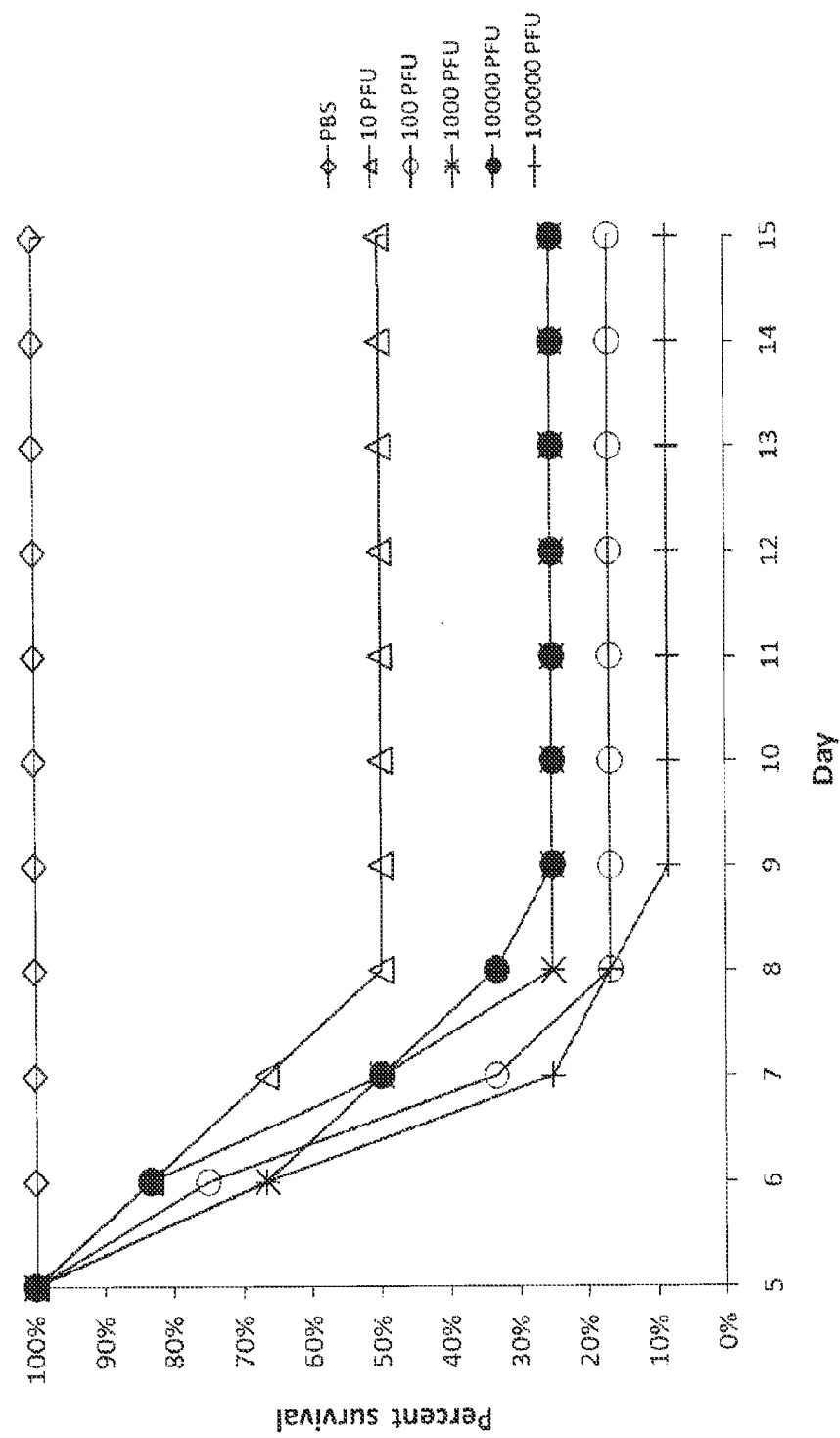
FIG. 7 is a graph which depicts experimental data illustrating that HSV2 infection in ovariectomized female BALB/c mice shows dose dependent survival.

Ovariectomized Mouse Model of HSV-2 Challenge:

Four week old BALB/c mice are ovariectomized (OVEX), allowed to recover for two weeks, and randomly placed into groups of twelve animals for experimental groups. Mice are infected intra-vaginally with PBS or a dose from 10 plaque forming units (PFU)-100000 PFU of HSV2, Strain 186, and monitored daily for survival out to Day 21 post-HSV2 infection. Vaginal swabs are collected on Day −1, +2, +6, and +7. Using this method, HSV2 infection in ovariectomized female BALB/c mice has been shown to exhibit dose dependent survival, as illustrated in FIG. 7.

Guinea Pig Model of Primary Genital HSV-2 Infection:

Because genital herpes disease in the guinea pig more closely resembles human disease, guinea pigs are used as a second species for therapies with demonstrated efficacy against HSV in mice. As with humans, genital HSV infection in guinea pigs is a self limited vesiculoulcerative disease which is followed by healing, the establishment of latency, and then both spontaneous and inducible symptomatic and asymptomatic recurrences. The model utilizes intravaginal inoculation of female Hartley guinea pigs and provides both clinical and virologic indices to assess both the effect of treatment on primary disease as well as on the frequency or severity of subsequent recurrent infections. Antiviral therapy can be administered by any suitable means including orally, topically, or systemically and can be given at varying intervals beginning before or after virus challenge. Following intravaginal inoculation, animals are followed daily for the development of genital herpes using a validated genital herpes scoring system. Vaginal swabs are also obtained to evaluate the effect against viral replication. Because this is a non lethal model, animals can be sacrificed at the conclusion of the experiment to evaluate the effects of treatment on latency. This model can be adapted to evaluate antiviral activity against available drug resistant strains (acyclovir (ACV) and foscarnet).

Dose and route of administration and duration of treatment are individualized for each experimental agent. For assessing drug requirements the average weight of the animals typically is 300 g. Treatment group size is typically 10-15 animals.

Guinea Pig Model of Recurrent Genital HSV-2 Infection:

The guinea pig model of genital herpes is unique in that, after recovery from primary genital infection, animals experience spontaneous recurrent genital lesions as well as viral shedding in the absence of lesions. This allows a candidate compound to be evaluated for efficacy in controlling recurrent disease. Female Hartley guinea pigs who have recovered from symptomatic primary genital infection are randomized into treatment groups for antiviral treatments beginning on day 15 post-infection (PI) and continuing for 48 days thereafter. Treatments can be administered by any suitable means including orally, topically, or systemically. The indices for these studies include quantification and severity assessment of recurrent episodes during treatment and for 21 days following cessation of treatment. Additionally, vaginal swabs are collected to evaluate any impact on shedding.

Dose and route of administration are individualized for each experimental agent. Treatment group size is typically 10-15 animals.

Model of Neonatal HSV-2 Infection in Guinea Pigs:

The model of neonatal HSV infection mimics the natural history of infection in the human newborn. This model is available to evaluate candidate antiviral drug therapies and combined therapeutic approaches including combinations of antivirals or antivirals and immune modulators. Additionally, this model can be used to evaluate the efficacy of candidate vaccines by measuring the protection afforded by a transplacental antibody. In this model newborn, Hartley guinea pigs are inoculated intranasally with HSV-2 within 48 hours of delivery. Newborn animals are then randomized to receive experimental drug, placebo, or ACV (control). Animals are evaluated daily for evidence of cutaneous herpetic disease and weight gain as well as pulmonary disorders, CNS symptoms, and death. Surviving animals are followed for 45 days to assess the effectiveness of therapy on the incidence and frequency of cutaneous herpetic recurrences.

Dose and route of administration are individualized for each experimental agent. Duration of treatment is typically 10 days or more. A positive control of ACV (60 mg/kg/day) twice daily (i.e., BID) can be used. Newborn guinea pigs typically weigh about 60-100 gms.

Additional information regarding animal models for use with the invention can be found in Hoshino et al., *J. Virol.*, 79(1): 410-418 (2005).

EXAMPLE 3

This example demonstrates that the administration of a vector comprising one or more nucleic acid sequences encoding one or more HSV antigens induces an immune response (T cell response) against HSV.

Two modified serotype 28 adenoviral vectors comprising hexon and fiber from a serotype 45 adenoviral vector (Ad28 H/F) were produced using the methods described in Example 1. The first vector comprised a nucleic acid sequence comprising SEQ ID NO: 7 (a wild-type (non-modified) UL47; designated LW01), while the second vector comprised a nucleic acid sequence comprising SEQ ID NO: 5 (inventive UL19 nucleic acid sequence; designated LW02).

T cell response in mice following a single intramuscular administration of each adenoviral vector-delivered antigen ($1\times10^9$ PU) was compared to natural infection ($1\times10^6$ PFU of HSV administered intravaginally) as described in Example 2. Animals infected with HSV showed symptoms of HSV infection. As a negative control, animals were injected with final formulation buffer (FFB-vehicle), which did not result in any induction of HSV specific T cells. The results of this experiment are depicted in FIGS. 1A and 1B.

Figure 1B:
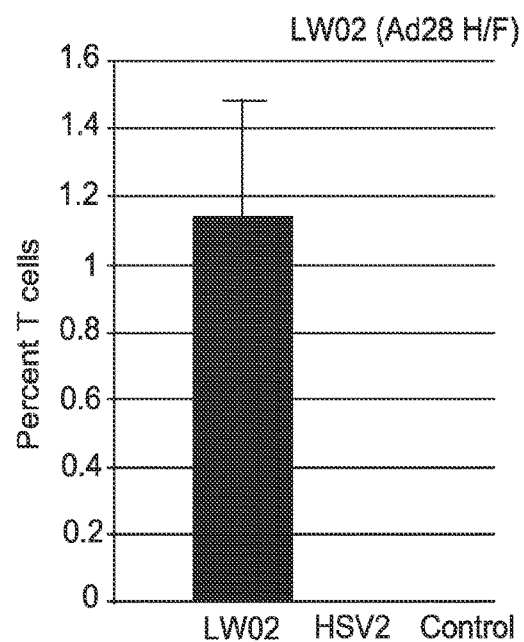

As demonstrated by the data set forth in FIGS. 1A and 1B, single administration of each of the adenoviral-delivered HSV antigens (the wild-type sequence of SEQ ID NO: 7 (LW01) and the inventive SEQ ID NO: 5 (LW02)) resulted in a strong T cell response when compared to the T cell response generated by natural infection with a wild-type HSV-2 and the T cell response of FFB-vaccinated animals.

The experiment was repeated with Ad28 H/F comprising a nucleic acid sequence comprising SEQ ID NO: 1 (inventive UL47; designated LW11). The results of this experiment are depicted in FIG. 2. As compared to Ad28 H/F comprising the wild-type sequence of SEQ ID NO: 7 (LW01) and Ad28H/F comprising SEQ ID NO: 3 (inventive UL47 containing ubiquitin; designated LW21), Ad28 H/F comprising LW11 resulted in a greater T cell response (see FIG. 2).

These results demonstrate that the administration of a vector (e.g., a serotype 28 adenoviral vector) comprising the inventive nucleic acid sequence encoding an HSV antigen induces an immune response (i.e., increases T cell response) against HSV. In particular, vaccination with a vector comprising an inventive UL47 nucleic acid sequence induced superior HSV-specific T cell levels as compared to a vector comprising a wild-type UL47 nucleic acid sequence, whereas additional modifications to the inventive UL47 nucleic acid sequence to include the ubiquitin sequence reduced HSV-specific T cell levels.

EXAMPLE 4

This example demonstrates the double administration (prime/boost) of a vector comprising the inventive nucleic acid sequence encoding an HSV antigen.

Mice were intramuscularly administered a priming dose of $1\times10^9$ PU of a serotype 28 adenoviral vector (Ad28) comprising SEQ ID NO: 7 (i.e., a wild-type UL47 nucleic acid sequence) followed four weeks later by a boosting dose of $1\times10^9$ PU of (i) Ad28 comprising SEQ ID NO: 7, (ii) modified serotype 28 adenoviral vector with hexon from serotype 45 adenovirus (Ad28H) comprising SEQ ID NO: 7, (iii) modified serotype 28 adenoviral vector with hexon and fiber from serotype 45 adenovirus (Ad28H/F) comprising SEQ ID NO: 7, or (iv) FFB (vehicle). The percentage of T cells was identified for each different boosting dose, and the resulting data is depicted in FIG. 3.

Figure 3:
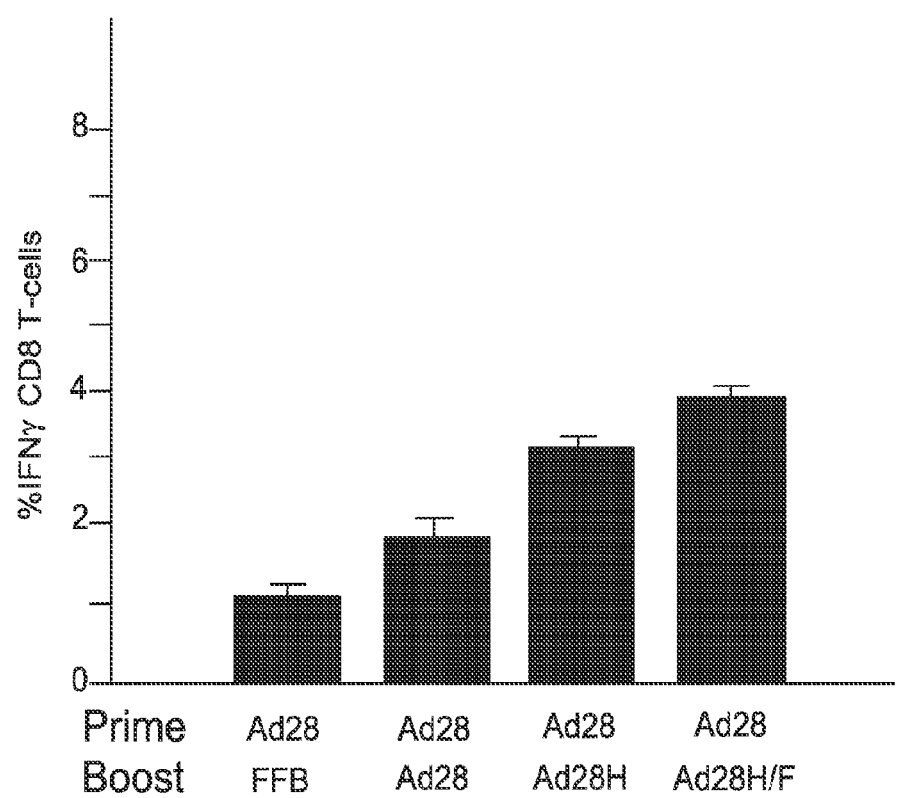

As demonstrated by the data set forth in FIG. 3, a heterologous prime/boost (Ad28 followed by Ad28 H or Ad28H/F) resulted in greater HSV-specific T cell responses than homologous prime/boost (Ad28 followed by Ad28) or single administration (administration of Ad28 followed by vehicle).

This example demonstrates the efficacy of a multi-administration (e.g., prime/boost) protocol with the inventive nucleic acids, vectors, and compositions.

EXAMPLE 5

This example further demonstrates that the inventive nucleic acid sequence encoding an HSV antigen stimulates robust T cell responses against the antigen.

Three different adenoviral vectors designated GC44 (SEQ ID NO: 10), GC45, (SEQ ID NO: 14), and GC46 (SEQ ID NO: 26) were modified by genetic engineering to (1) be replication-deficient by deletion of the E1 region and (2) comprise SEQ ID NO: 5 (inventive UL19 nucleic acid sequence; designated LW02). More specifically, a nucleic acid sequence comprising SEQ ID NO: 5 was introduced between a CMV promoter and the SV40 early polyA. The CMV promoter combines the CMV immediate early high expression enhancer/promoter with tetracycline operator sites. Within this sequence is the viral enhancer, CAAT box, TATA box, two copies of the 20 nucleotide tetracycline operator sequence (tetO) from transposon Tn10, and the CMV transcription start site. The tetO sites are inactive in mammalian cells since tetracycline-based gene expression regulation is specific for a prokaryotic system (see, e.g., Blau et al., *Proc. Natl. Acad. Sci USA.*, 96(3): 797-799 (1999)). The tetO sites inhibit transgene expression when the viral vector is propagated in a cell line in the presence of the tetracycline repressor. To further optimize the expression of the nucleic acid sequence comprising SEQ ID NO: 5 from the CMV promoter, an artificial intron was created in the sequence by placing a splice donor and a splice acceptor sequence upstream of the initiation codon for the nucleic acid sequence comprising SEQ ID NO: 5.

The resulting adenoviral vectors designated GC44 LW02, GC45 LW02, and GC46 LW02 were propagated in a genetically stable 293-ORF6-cell line that constitutively expresses the tetracycline repressor protein (TetR), which has been named M2A. The M2A cell line has been shown to efficiently reduce adenoviral vector transgene expression during adenoviral vector construction and growth (see, e.g., U.S. Patent Application Publication 2008/0233650 A1).

T cell response following single intramuscular administration of each of the adenoviral vectors comprising SEQ ID NO: 5 ($1\times10^9$ PU) was assessed in a mouse and compared to administration of a human adenoviral vector serotype 5 (Ad5) comprising SEQ ID NO: 5 or control (FFB). The resulting data is set forth in FIG. 4. As demonstrated by the data set forth in FIG. 4, single administration of each adenoviral vector comprising SEQ ID NO: 5 resulted in a strong T cell response.

These results demonstrate that the inventive nucleic acid sequence encoding an HSV antigen stimulated a robust T cell response against the antigen. In particular, when delivered with GC44, GC45, and GC46, the inventive nucleic acid sequences resulted in high T cell response.

EXAMPLE 6

This example demonstrates that administration of a vector comprising an inventive nucleic acid sequence encoding an HSV antigen decreases HSV infection symptoms (mean lesion score) and increases longevity (survival).

Ovariectomized female Balb/c mice were given a single intramuscular vaccination of $10^8$ pu of GC45 LW02. As a positive control, one group of animals was injected with FFB (vehicle). Wild-type HSV-2 was administered intravaginally two weeks subsequent to immunization. One group of animals was not immunized but given Phosphate Buffered Saline (PBS) intravaginally as negative control for HSV infection. The animals were evaluated for lesions and death rate, and the resulting data is set forth in FIGS. 5A and 5B.

Figure 5A:
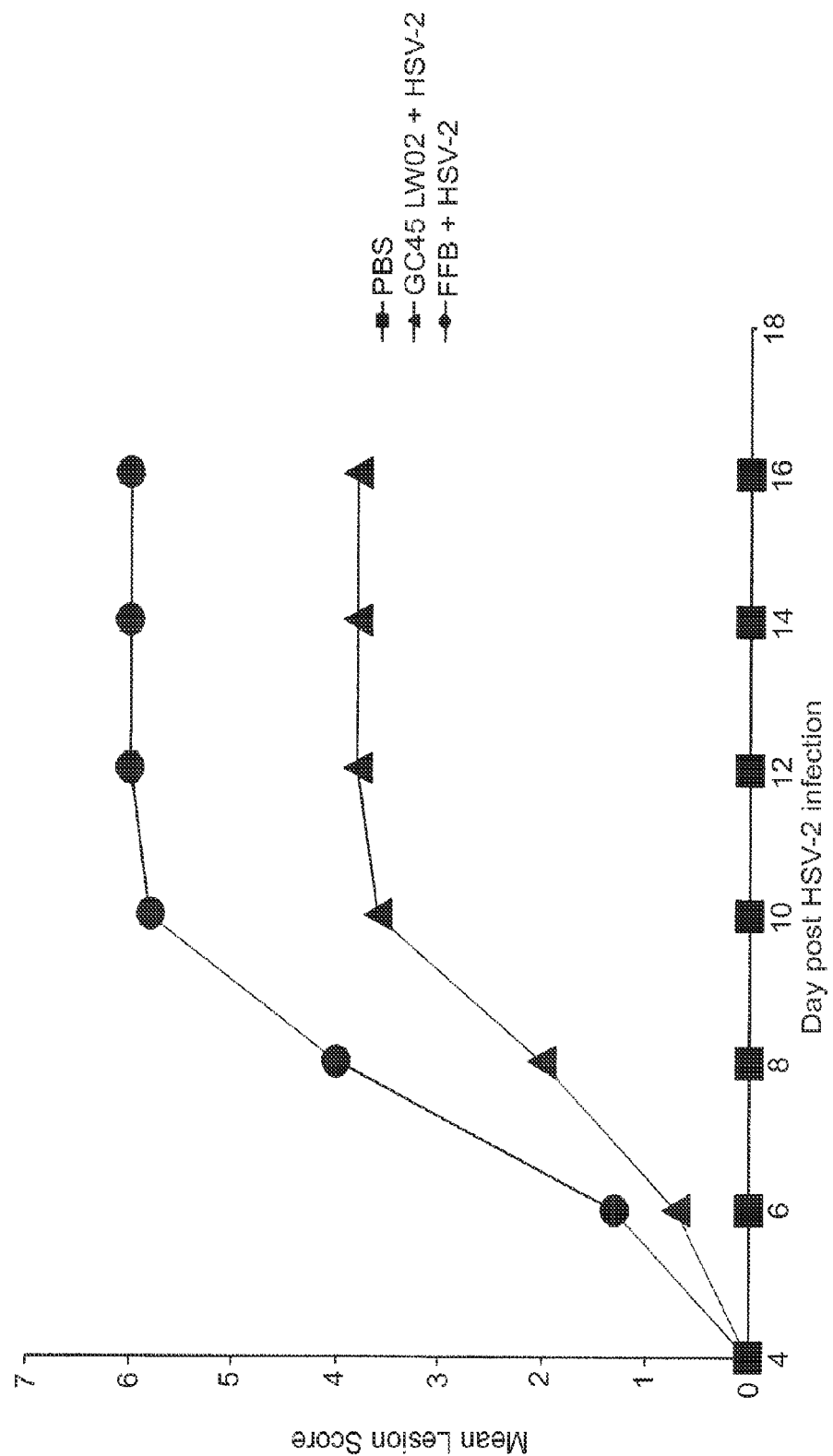

As shown in FIG. 5A, a single administration with GC45 LW02 resulted in a decrease in mean lesion score for those animals as compared to the FFB-treated animals also receiving HSV infection. The PBS-treated (non-HSV infected) mice had no lesions as expected.

FIG. 5B shows that immunization with GC45 LW02 resulted in a higher number of animals living both longer and not succumbing to the HSV-2 disease as compared to the FFB-treated group. All the HSV-infected animals administered FFB succumbed to disease by Day 12. All of the PBS-treated (non-HSV infected) mice survived as expected.

EXAMPLE 7

This example demonstrates that a single administration of an adenoviral vector comprising an inventive nucleic acid sequence encoding an HSV antigen induces robust antigen-specific T cell responses.

A human serotype 28 adenoviral vector was prepared with a deletion in the E1 region, the replacement of the hexon region and the fiber region with the hexon and fiber regions of a human serotype 45 adenovirus, and the insertion of the inventive UL19-encoding nucleic acid sequence comprising SEQ ID NO: 5 (Ad28HF.UL19), as described in Example 1. Gorilla adenoviral vectors designated GC46 (SEQ ID NO: 26) were prepared containing a deletion in the E1 region and an insertion of the inventive UL19-encoding nucleic acid sequence comprising SEQ ID NO: 5 or the inventive UL47-encoding nucleic acid sequence comprising SEQ ID NO: 1, as described in Example 5. The resulting gorilla adenoviral vectors were designated GC46.UL19 and GC46.UL47.

Figure 6A:
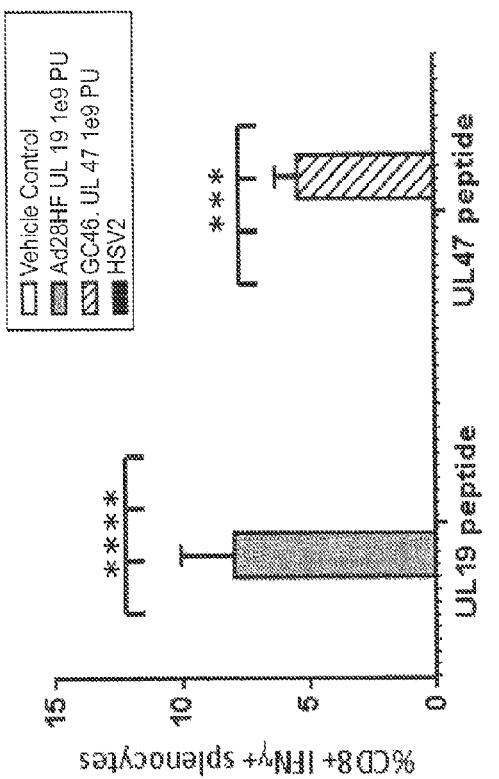
Figure 6B:
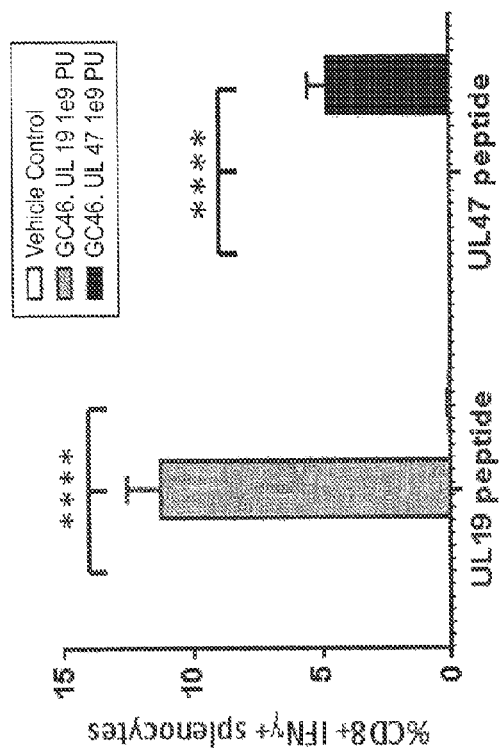

Five BALB/c animals received a single intramuscular (IM) administration ($1 \times 10^9$ particle units (pu)) of GC46.UL19, GC46.UL47, or vehicle control. Another group of five BALB/c mice were either immunized with a single IM administration ($1 \times 10^9$ pu) of Ad28HF.UL19, GC46.UL19, GC46.UL47, or vehicle control, or were infected with $1 \times 10^4$ to $1 \times 10^6$ plaque forming units (PFU) of HSV2, Strain 186 intra-vaginally. Two weeks later, splenocytes were harvested and re-stimulated for 6 hours with UL19 and UL47-specific peptides for production of IFN-γ cytokine as measured by intracellular cytokine staining via FACS analysis. The results of these experiments are set forth in FIGS. 6A and 6B. A single administration of either Ad28HF.UL19, GC46.UL19, GC46.UL47 induced robust antigen-specific T cell responses that were significantly greater than T cell responses induced by HSV2 infection. One animal infected with HSV2 died from infection before harvest. No T cell response was detected in animals infected with up to $1 \times 10^6$ PFU of HSV2.

The results of this example demonstrate that a single administration of the inventive adenoviral vectors can induce strong HSV2-specific immune responses in animals.

EXAMPLE 8

This example demonstrates that a single administration of a blend of adenoviral vectors encoding the inventive HSV2 antigens reduces HSV2 symptoms in a mouse challenge model.

Figure 8:
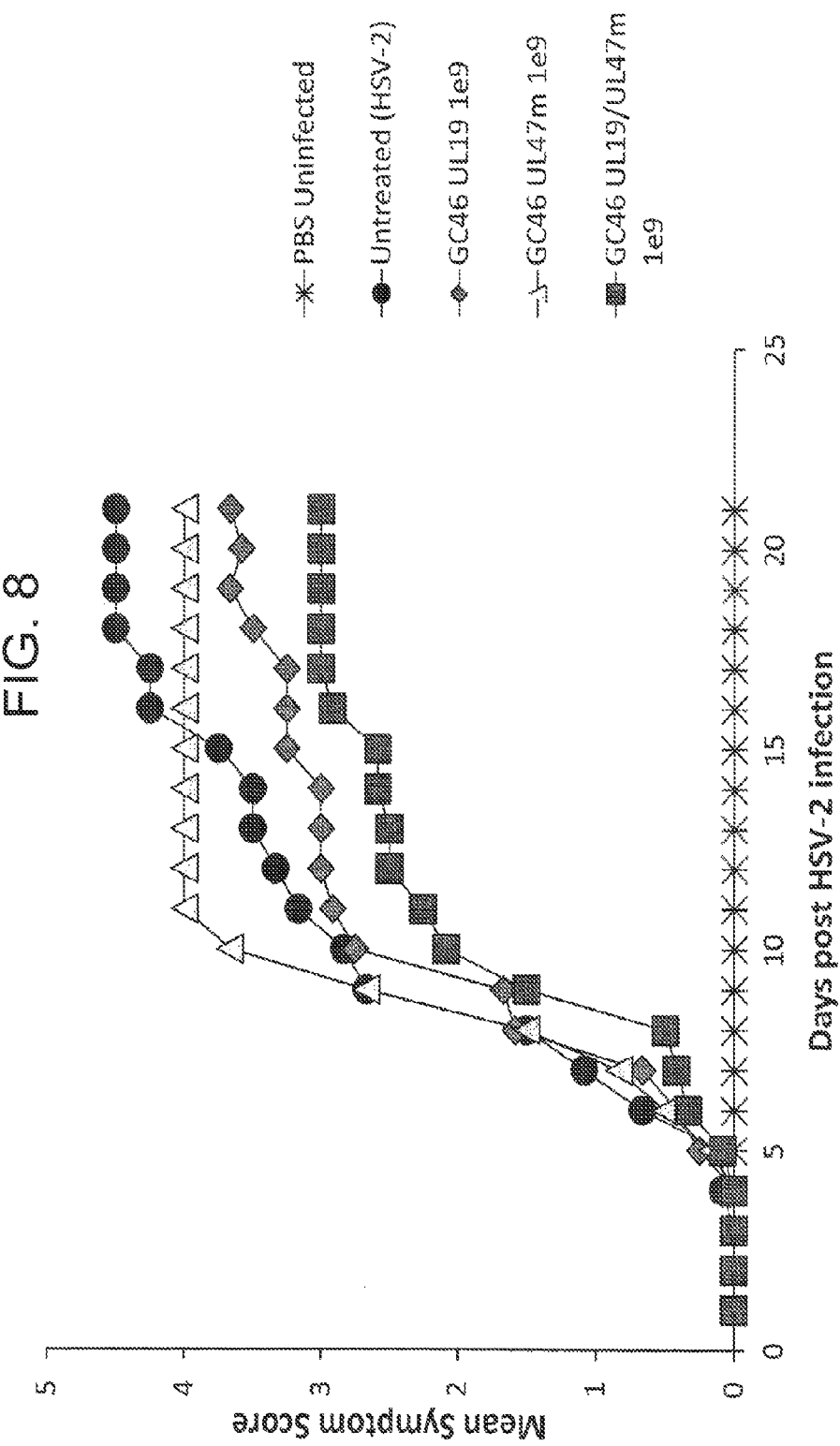
FIG. 8 is a graph which depicts experimental data illustrating that a single administration of a blend of the gorilla adenoviral vectors GC46.UL19 and GC46.UL47 reduces HSV2 symptoms following HSV2 infection in mice as compared to administration of either GC46.UL19 or GC46.UL47 alone.

Ovariectomized BALB/c mice described in Example 2 were randomized into groups of 12 animals. Mice were immunized IM with $1 \times 10^9$ pu each of the adenoviral vector GC46.UL19, the adenoviral vector GC46.UL47, a blend of GC46.UL19 and GC46.UL47 ($1 \times 10^9$ pu each), or PBS. Two weeks later, mice were challenged intra-vaginally with HSV2, Strain 186, and monitored daily for clinical symptoms. The results of this experiment are set forth in FIG. 8.

Figure 9A:
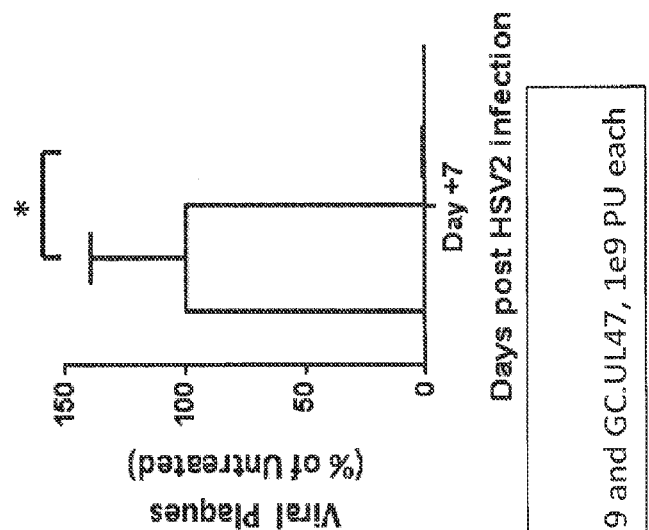
FIGS. 9A and 9B are graphs which depict experimental data illustrating that a single administration of a blend of the gorilla adenoviral vectors GC46.UL19 and GC46.UL47 reduces HSV2 viral shedding in mice as measured by qPCR (FIG. 9A) and plaque assay (FIG. 9B).
Figure 9B:
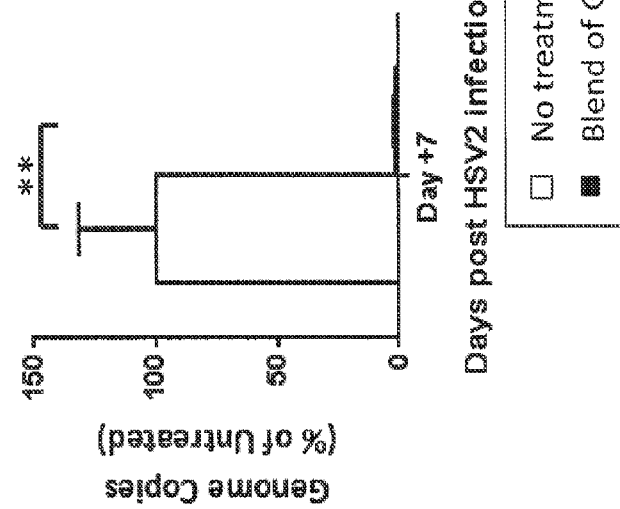

HSV2 viral shedding in treated mice was assayed using quantitative PCR (qPCR) and a plaque assay. Specifically, vaginal swabs were collected from the experimental animals, and analyzed for (a) the amount of genome copies detectable by quantitative PCR (qPCR) (LOD/LOQ=2/20) and (b) the amount of live virus titer by plaque assay on Vero cell monolayers (LOD/LOQ=1/10). The results of the qPCR and plaque assays are shown in FIGS. 9A and 9B.

The results of this example demonstrate that a single administration of a blend of the inventive adenoviral vectors reduces symptoms of HSV2 infection and viral shedding upon challenge with HSV2 in a mouse model.

EXAMPLE 9

This example demonstrates that a single administration of a blend of adenoviral vectors encoding the inventive HSV2 antigens reduces the incidence and severity of HSV2 symptoms in a guinea pig model.

The guinea pig model of recurrent genital HSV-2 infection described in Example 2 was utilized for these experiments. Specifically, four to six week old female Hartley guinea pigs were infected intra-vaginally with 5000 PFU of HSV2, Strain G, and randomized into treatment groups. On day 9 following infection, animals received a single IM injection of $2 \times 10^8$ pu each of the adenoviral vector GC46.UL19 and the adenoviral vector GC46.UL47 (described in Example 7). Animals not receiving any treatment served as a control. Daily observations for lesion incidence and lesion scores were performed. The results of these experiments are shown in FIGS. 10A and 10B. A single administration of a blend of GC46.UL19 and GC46.UL47 reduced the incidence and severity of HSV2 symptoms, and these effects were observed out to 63 days post immunization.

The results of this example demonstrate that a single administration of a blend of the inventive adenoviral vectors reduces the recurrence and severity of HSV2 lesions in a guinea pig model.

EXAMPLE 10

This example demonstrates that a homologous prime/boost immunization method using the inventive adenoviral results in enhanced vaccine efficiency.

Figure 11:
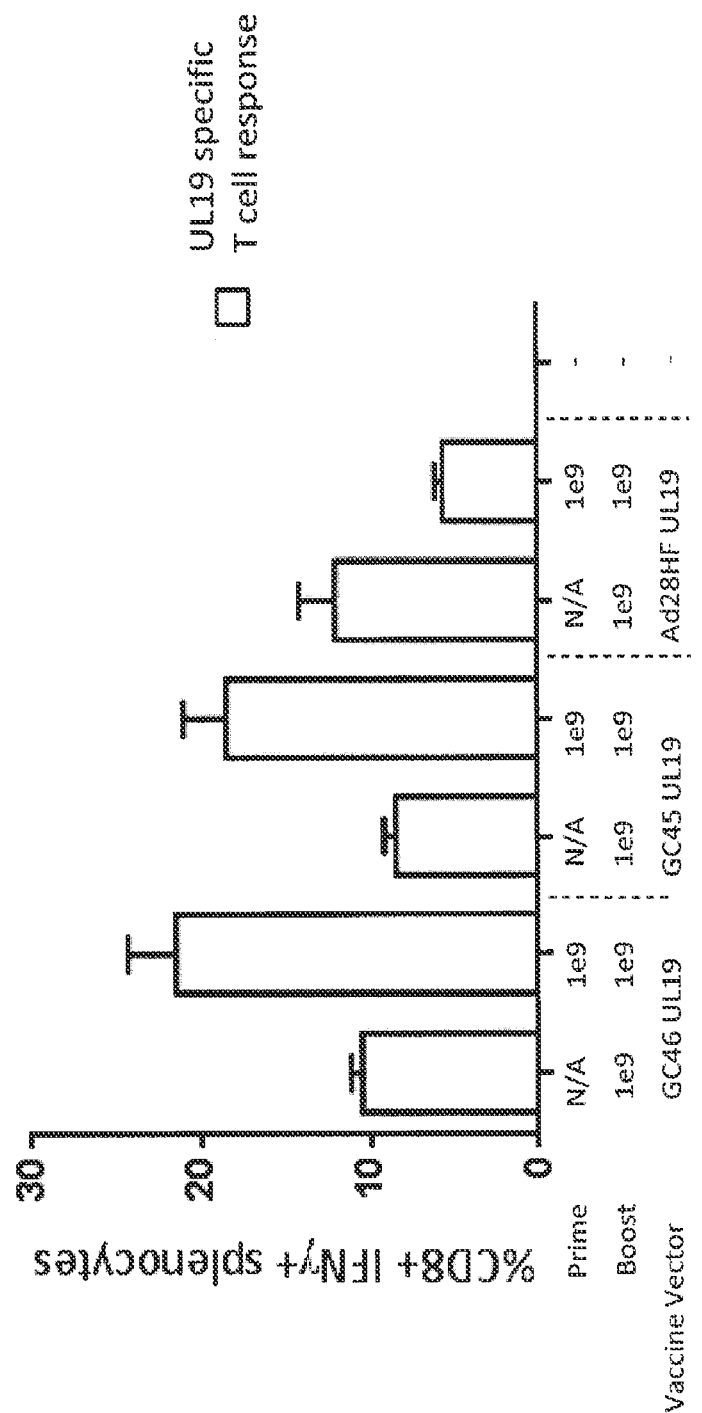
FIG. 11 is a graph which depicts experimental data illustrating that a homologous prime/boost immunization method utilizing the GC46.UL19 vector or the GC45.UL19 vector results in enhanced T cell responses as compared to single administration of either vector. In contrast, T cell responses decreased following homologous boosting with the Ad28HF UL19 vector.

BALB/c mice were immunized with a single $1 \times 10^9$ pu dose of GC46.UL19 (described in Example 7), GC45.UL19 (referred to as "GC45 LW02" in Example 5), Ad28HF UL19 (described in Example 7), or vehicle control on Day 0. After 12 weeks, animals were immunized with a second dose of $1 \times 10^9$ pu of the same vector administered on day 0 (i.e., mice receiving GC46.UL19 on day 0 received a second dose of GC46.UL19 at 12 weeks). Two weeks later, splenocytes were collected and re-stimulated for 6 hours with UL19-specific peptides, and cytokine production was measured by intracellular staining via FACS. The results of this experiment are shown in FIG. 11. Repeat vaccination of mice with GC46 or GC45 vectors resulted in a boost of vaccine efficacy which was not observed with the Ad28HF vector.

The results of this example demonstrate that repeated administration of gorilla adenoviral vectors encoding the inventive HSV2 UL19 antigen enhances HSV2 T cell responses as compared to repeated administration of a human adenoviral vector encoding the same antigen.

EXAMPLE 11

This example demonstrates that a homologous prime/boost immunization method using an adenoviral vector encoding the inventive UL19 and UL47 antigens results in enhanced vaccine efficiency.

Using the methods described in Example 5, the GC46 adenoviral vector GC46 UL19/UL47 was generated by genetic engineering to (1) be replication-deficient by deletion of the E1 region and the E4 region, (2) comprise SEQ ID NO: 5 (inventive UL19 nucleic acid sequence), and (3) comprise SEQ ID NO: 1 (inventive UL47 nucleic acid sequence).

BALB/c mice were immunized IM on Day 0 with $1 \times 10^7$ pu of the GC46 UL19/UL47 vector or vehicle control. After one month (day 28), animals were immunized with a second dose of $1 \times 10^7$ pu of GC46 UL19/UL47, or vehicle control. One group of animals was not administered a boosting immunization. Two weeks later, splenocytes and mucosa were collected and re-stimulated for 6 hours with UL19 and UL47-specific peptides, and cytokine production was measured by intracellular staining via FACS. The results of this experiment are shown in FIGS. 12A and 12B. Repeated vaccination of mice with the GC46 UL19/UL47 vector resulted in a boost of vaccine efficacy with respect to both UL19-specific and UL47-specific immune responses. A single IM administration of the GC46 UL19/UL47 elicited mucosal T cell responses, and these mucosal T cell responses were enhanced with repeated vaccination with the GC46 UL19/UL47 vector.

The results of this example demonstrate that a single IM administration of a gorilla adenoviral vector encoding the inventive HSV2 UL19 antigen and the inventive HSV2 UL47 antigen elicit mucosal immunity in vivo, and that both mucosal and systemic immune responses are enhanced with repeated administration of the same vector.

EXAMPLE 12

This example demonstrates that a heterologous prime/boost immunization method using the inventive adenoviral results in enhanced vaccine efficiency.

BALB/c mice were immunized on Day 0 with $1 \times 10^9$ pu of the GC45.UL19 adenoviral vector (referred to as "GC45 LW02" in Example 5), or vehicle control. After three months (week 12), animals were immunized with $1 \times 10^9$ pu of GC45.UL19, $1 \times 10^9$ pu of the GC46.UL19 vector (described in Example 7), or vehicle control. Two weeks later, splenocytes were collected and re-stimulated for 6 hours with UL19- and UL47-specific peptides, and cytokine production was measured by intracellular staining via FACS. The results of this experiment are shown in FIG. 13. Administration of GC45.UL19 as a prime followed by GC46.UL19 as a boost produced enhanced T cell responses as compared to administration of either GC45.UL19 or GC46.UL19 alone.

EXAMPLE 13

This example demonstrates that a single administration of an adenoviral vector comprising an inventive nucleic acid sequence encoding an HSV antigen induces durable T cell responses.

BALB/c mice were immunized on Day 0 with a single IM injection of GC46.UL19 (described in Example 7). Mice were sacrificed at weeks 2, 5, 14, and 26 following immunization. Splenocytes were harvested, and re-stimulated for 6 hours with UL19-specific peptides for production of IFN-γ cytokine as measured by intracellular cytokine staining via FACS analysis. The results of this experiment are shown in FIG. 14. The pattern of CD8+ T cell responses induced following a single administration of GC46.UL19 were long-lasting (i.e., durable). In contrast the T cell response is extremely low or non-existent following normal infection by HSV2.

All references, including publications, patent applications, and patents, cited herein are hereby incorporated by reference to the same extent as if each reference were individually and specifically indicated to be incorporated by reference and were set forth in its entirety herein.

The use of the terms "a" and "an" and "the" and similar referents in the context of describing the invention (especially in the context of the following claims) are to be construed to cover both the singular and the plural, unless otherwise indicated herein or clearly contradicted by context. The terms "comprising," "having," "including," and "containing" are to be construed as open-ended terms (i.e., meaning "including, but not limited to,") unless otherwise noted. Recitation of ranges of values herein are merely intended to serve as a shorthand method of referring individually to each separate value falling within the range, unless otherwise indicated herein, and each separate value is incorporated into the specification as if it were individually recited herein. All methods described herein can be performed in any suitable order unless otherwise indicated herein or otherwise clearly contradicted by context. The use of any and all examples, or exemplary language (e.g., "such as") provided herein, is intended merely to better illuminate the invention and does not pose a limitation on the scope of the invention unless otherwise claimed. No language in the specification should be construed as indicating any non-claimed element as essential to the practice of the invention.

Preferred embodiments of this invention are described herein, including the best mode known to the inventors for carrying out the invention. Variations of those preferred embodiments may become apparent to those of ordinary skill in the art upon reading the foregoing description. The inventors expect skilled artisans to employ such variations as appropriate, and the inventors intend for the invention to be practiced otherwise than as specifically described herein. Accordingly, this invention includes all modifications and equivalents of the subject matter recited in the claims appended hereto as permitted by applicable law. Moreover, any combination of the above-described elements in all possible variations thereof is encompassed by the invention unless otherwise indicated herein or otherwise clearly contradicted by context.

SEQUENCE LISTING (28 sequences)

SEQ ID NO: 1 - DNA, 1686 bp, Artificial Sequence
  Synthetic
atggagacttcagtcagagggcacgcagtacggaggcgacgcgccagcaccagatcgcacgccccctcggcacatagggcggactccccggtggaggacgaacccgaaggagggggagtgggactcatggaaaccgggtatctccgggcagtctttaacgtggatgatgacagcgaggtagaggcagcgggtgaaatggagacagcctccgaagagccaccccctagacggcggagagaagcgagaggacatcccggttccagacgggcatcagaagcgagggccgcagctccgcctcgaagggcgtccttccctagaccacgctcagtgacggcgaggtcgcagtccgtccgcggcagacgggactcggccatcactcgagcgccgaggggtgggtatctgggaccgatggagacagatccgcgggacgtgctggggcgagtcggaggcagccgggtggtgccctcgcccttgttcctcgatgagcttaactacgaggaggatgactaccctgctgccgtcgcgcatgacgacggacccggagcgaggccgtccgcgacggtcgagattcttgcgggtcgcgtgagcggaccagaattgcaggcggccttccctctcgatcgcttgacgcccagggtagccgcttgggatgaatccgtacgctcagcactggcgctggggcacccagccggcttctacccatgcccggactccgcctttgggttgtcgcgcgtaggggtcatggagacacactttgcatcgcctgctgatccgaaagtgttctttcgacaaacactgcagcagggggaggctctggcatggtatgtcactggggatgcgatcttggacctcaccgatcgacgggccaaaacatcgcctagccgggctatggagacaggattcctcctcgacgcggctgtacgggtcgcgatcaacggttgggtatgtggaacgagattgcataccgaaggacgcggatcggaacttgacgatcgcgcagcagaacttcggagacagttcgcatcgctcacggccctccggccagtgggagcagccgcggtgccattgctctccgcgggaggggctgcgcctccccacccgggtccggatgcggccgtgttccgctcatcgttggggtcattgctttactggcctggcgtccgggctctgcttggcagggactgcagggtcgccgccagatacgcgggtaggatggaaacgacctatatcgcgacgggggcactgctcgccaggttcaatcccggtgccgtgaagtgtgtcctgccgcgagaagccgcgttcgctgggagagtgctggacgtcctggcggtgctggcagagcaaacagtacagtggctctcggtggtagtcggtgcccgcttgcatccccactcagcgcacccggcatttgccgacgtcgaacaggaggcgctgtttcgcgcccttccccttgggtcacccggagtggtcgcagctgagcacgaagcccttggggatacagcggcacgccggttgctggcgacatcgggtcttaatgcggtgttgggtgcggcggtgtacgcgctccataccgcgctggccaccgtcactttgaaatacgcactggcgtgcggggatgcacgccgacgcagggatgacgcggcagccgccagagctgtacttgcgaccggattgattcttcagtag

SEQ ID NO: 2 - protein, 561 aa, Artificial Sequence
  Synthetic
METSVRGHAVRRRRASTRSHAPSAHRADSPVEDEPEGGGVGLMETGYLRAVFNVDDDSEVEAAGEMETASEEPPPRRRREARGHPGSRRASEARAAAPPRRASFPRPRSVTARSQSVRGRRDSAITRAPRGGYLGPMETDPRDVLGRVGGSRVVPSPLFLDELNYEEDDYPAAVAHDDGPGARPSATVEILAGRVSGPELQAAFPLDRLTPRVAAWDESVRSALALGHPAGFYPCPDSAFGLSRVGVMETHFASPADPKVFFRQTLQQGEALAWYVTGDAILDLTDRRAKTSPSRAMETGFLLDAAVRVAINGWVCGTRLHTEGRGSELDDRAAELRRQFASLTALRPVGAAAVPLLSAGGAAPPHPGPDAAVFRSSLGSLLYWPGVRALLGRDCRVAARYAGRMETTYIATGALLARFNPGAVKCVLPREAAFAGRVLDVLAVLAEQTVQWLSVVVGARLHPHSAHPAFADVEQEALFRALPLGSPGVVAAEHEALGDTAARRLLATSGLNAVLGAAVYALHTALATVTLKYALACGDARRRRDDAAAARAVLATGLILQ

SEQ ID NO: 3 - DNA, 1914 bp, Artificial Sequence
  Synthetic
atgcagatcttcgtgaaaacgcttacgggaaagacgatcacgctggaggtagaaccgtcagacacaattgagaatgtgaaggccaagatccaagataaagagggcattcccccagaccagcagagattgatctttgccgggaagcagttggaggacggaagaacgttgagcgactataacattcaaaaggagtcgacactccacctcgtgcttcgcctccgaggtggtagggagacttcagtcagagggcacgcagtacggaggcgacgcgccagcaccagatcgcacgccccctcggcacatagggcggactccccggtggaggacgaacccgaaggagggggagtgggactcatggaaaccgggtatctccgggcagtctttaacgtggatgatgacagcgaggtagaggcagcgggtgaaatggagacagcctccgaagagccaccccctagacggcggagagaagcgagaggacatcccggttccagacgggcatcagaagcgagggccgcagctccgcctcgaagggcgtccttccctagaccacgctcagtgacggcgaggtcgcagtccgtccgcggcagacgggactcggccatcactcgagcgccgaggggtgggtatctgggaccgatggagacagatccgcgggacgtgctggggcgagtcggaggcagccgggtggtgccctcgcccttgttcctcgatgagcttaactacgaggaggatgactaccctgctgccgtcgcgcatgacgacggacccggagcgaggccgtccgcgacggtcgagattcttgcgggtcgcgtgagcggaccagaattgcaggcggccttccctctcgatcgcttgacgcccagggtagccgcttgggatgaatccgtacgctcagcactggcgctggggcacccagccggcttctacccatgcccggactccgcctttgggttgtcgcgcgtaggggtcatggagacacactttgcatcgcctgctgatccgaaagtgttctttcgacaaacactgcagcagggggaggctctggcatggtatgtcactggggatgcgatcttggacctcaccgatcgacgggccaaaacatcgcctagccgggctatggagacaggattcctcctcgacgcggctgtacgggtcgcgatcaacggttgggtatgtggaacgagattgcataccgaaggacgcggatcggaacttgacgatcgcgcagcagaacttcggagacagttcgcatcgctcacggccctccggccagtgggagcagccgcggtgccattgctctccgcgggaggggctgcgcctccccacccgggtccggatgcggccgtgttccgctcatcgttggggtcattgctttactggcctggcgtccgggctctgcttggcagggactgcagggtcgccgccagatacgcgggtaggatggaaacgacctatatcgcgacgggggcactgctcgccaggttcaatcccggtgccgtgaagtgtgtcctgccgcgagaagccgcgttcgctgggagagtgctggacgtcctggcggtgctggcagagcaaacagtacagtggctctcggtggtagtcggtgcccgcttgcatccccactcagcgcacccggcatttgccgacgtcgaacaggaggcgctgtttcgcgcccttccccttgggtcacccggagtggtcgcagctgagcacgaagcccttggggatacagcggcacgccggttgctggcgacatcgggtcttaatgcggtgttgggtgcggcggtgtacgcgctccataccgcgctggccaccgtcactttgaaatacgcactggcgtgcggggatgcacgccgacgcagggatgacgcggcagccgccagagctgtacttgcgaccggattgattcttcagtag

SEQ ID NO: 4 - protein, 637 aa, Artificial Sequence
  Synthetic
MQIFVKTLTGKTITLEVEPSDTIENVKAKIQDKEGIPPDQQRLIFAGKQLEDGRTLSDYNIQKESTLHLVLRLRGGRETSVRGHAVRRRRASTRSHAPSAHRADSPVEDEPEGGGVGLMETGYLRAVFNVDDDSEVEAAGEMETASEEPPPRRRREARGHPGSRRASEARAAAPPRRASFPRPRSVTARSQSVRGRRDSAITRAPRGGYLGPMETDPRDVLGRVGGSRVVPSPLFLDELNYEEDDYPAAVAHDDGPGARPSATVEILAGRVSGPELQAAFPLDRLTPRVAAWDESVRSALALGHPAGFYPCPDSAFGLSRVGVMETHFASPADPKVFFRQTLQQGEALAWYVTGDAILDLTDRRAKTSPSRAMETGFLLDAAVRVAINGWVCGTRLHTEGRGSELDDRAAELRRQFASLTALRPVGAAAVPLLSAGGAAPPHPGPDAAVFRSSLGSLLYWPGVRALLGRDCRVAARYAGRMETTYIATGALLARFNPGAVKCVLPREAAFAGRVLDVLAVLAEQTVQWLSVVVGARLHPHSAHPAFADVEQEALFRALPLGSPGVVAAEHEALGDTAARRLLATSGLNAVLGAAVYALHTALATVTLKYALACGDARRRRDDAAAARAVLATGLILQ

SEQ ID NO: 5 - DNA, 4125 bp, Artificial Sequence
  Synthetic
atggctgcccctgccagagatccccctggctacagatacgccgctgccatcctgcctaccggcagcatcctgagcaccatcgaggtggccagccacagacggctgttcgacttcttcgccgccgtgcggagcgatgagaacagcctgtacgacgtggagttcgacgccctgctgggcagctactgcaacaccctgagcctggtccggttcctggaactgggcctgagcgtggcctgtgtgtgcaccaagttccccgagctggcctacatgaacgagggccgggtgcagtttgaggtgcaccagcccctgatcgccagagatggcccccaccctgtggagcagcccgtgcacaactacatgaccaaggtgatcgacagacgggccctgaatgccgcctttagcctggccacagaggccatcgccctgctgacaggcgaagccctggatggcaccggcatcagcctgcacaggcagctgagggccattcagcagctggcccggaatgtgcaggctgtgctgggcgcctttgagagaggcaccgccgaccagatgctgcacgtgctgctggaaaaggcccctcctctggccctgctgctgcccatgcagagatacctggacaacggccggctggccacaagagtggccagagccaccctggtggccgagctgaagcggagcttctgcgataccagcttcttcctgggcaaggccggccacagaagggaagccatcgaggcctggctggtcgatctgaccaccgccacccagccatctgtggccgtgcccagactgacccacgccgacaccagaggcagacccgtggatggcgtgctggtgaccacagccgccatcaagcagcggctgctgcagagcttcctgaaggtggaggacaccgaggccgatgtgcctgtgacctacggcgagatggtgctgaacggcgccaatctggtgaccgccctggtgatgggcaaagccgtgagatccctggacgacgtgggcagacacctgctggacatgcaggaagagcagctggaagccaaccgggagaccctggatgagctggaaagcgcccctcagaccaccagagtgcgggccgatctggtggccatcggcgacaggctggtgttcctggaagctctggaacggcggatctacgccgccaccaacgtgccttaccctctggtcggcgccatggacctgaccttcgtgctgcccctgggcctgttcaaccccgccatggaaaggtttgccgcccacgccggcgatctggtgcctgcccctggccaccctgaacccagagccttcccccccagacagctgttcttctggggcaaggaccaccaggtgctgagactgagcatggaaaacgccgtgggcaccgtgtgtcaccccagcctgatgaacatcgacgccgccgtgggcggagtgaaccacgatcctgtggaggccgccaatccctacggcgcctacgtggctgctcctgctggaccaggcgccgacatgcagcagcggtttctgaacgcctggcggcagagactggcccacggcagagtgagatgggtggccgagtgccagatgaccgccgagcagttcatgcagcccgacaacgccaacctggccctggaactgcaccccgccttcgatttctttgccggcgtggccgatgtggaactgccaggcggcgaagtgcctccagctggccctggcgccatccaggccacatggcgggtggtgaacggcaatctgccactggccctgtgccctgtggccttcagagatgccagggggctggaactgggagtgggcaggcatgccatggcccctgccacaattgccgccgtgaggggcgccttcgaggacagatcctaccccgccgtgttctacctgctgcaggccgccatccatggcaacgagcacgtgttctgcgccctggccagactggtgacccagtgcatcaccagctactggaacaacaccagatgcgccgccttcgtgaacgactacagcctggtgtcctacatcgtgacctacctgggcggcgacctgcctgaggaatgcatggccgtgtaccgggacctggtggcccatgtggaggctctggcccagctggtcgacgacttcaccctgcctggccctgagctgggaggacaggcccaggccgaactgaaccacctgatgcgggaccctgctctgctgcctcccctggtctgggattgcgacggcctgatgagacacgccgccctggacaggcaccgggactgcagaatcgatgccggcggacacgagcctgtgtacgctgccgcctgcaatgtggccaccgccgacttcaaccggaacgacggcaggctgctgcacaacacccaggccagagccgccgatgccgccgacgacagacctcacagacccgccgactggaccgtgcaccacaagatctactactacgtgctggtgcccgccttcagcagaggcaggtgctgtacagccggcgtgcggttcgacagagtgtacgccaccctgcagaacatggtggtgcccgagattgcccctggcgaggaatgccccagcgaccccgtgacagatcctgcccaccctctgcaccctgccaacctggtggctaacaccgtgaagcggatgttccacaacggcagggtggtggtggatggccctgccatgctgaccctgcaggtgctggcccacaacatggccgagaggaccacagccctgctgtgttctgccgcccctgacgctggcgccaataccgccagcaccgccaacatgcggatcttcgacggcgccctgcatgctggcgtcctgctgatggccccccagcacctggatcacaccatccagaacggcgagtacttttacgtgctgcccgtgcacgccctgtttgccggcgctgaccacgtggccaacgcccccaatttcccccctgccctgagggatctggccagggacgtgcctctggtgcctcctgccctgggcgccaactacttcagcagcatccggcagcctgtggtgcagcatgccagagaatctgccgctggcgagaacgccctgacctacgccctgatggccggctacttcaagatgagccccgtggccctgtatcaccagctgaaaaccggcctgcaccctggcttcggctttaccgtggtgcggcaggacagattcgtgaccgagaacgtgctgttcagcgagagagccagcgaggcctacttcctgggccagctccaggtggccagacacgaaacaggcgggggagtgaatttcaccctgacccagcccagaggcaacgtggatctgggcgtgggctatacagccgtggccgccaccggcaccgtgagaaaccccgtgaccgacatgggcaacctgccccagaacttctacctgggcaggggagcccctcccctgctggataatgccgccgctgtgtacctgaggaacgccgtggtggccggcaatagactcggacccgcccagcctctgcctgtgttcggctgcgcccaggtgccaagacgggccggaatggaccacggacaggacgccgtgtgcgagttcatcgccacccccgtggccaccgacatcaactactttcggaggccctgcaaccctagaggaagggccgctggcggagtgtatgccggcgacaaggaaggcgacgtcatcgccctgatgtacgaccacggccagagcgatcccgccagaccttttgccgccaccgccaacccttgggccagccagaggttcagctacggcgatctgctgtacaatggcgcctaccacctcaatggcgccagccctgtgctgtccccctgcttcaagttcttcacagccgccgacatcaccgccaagcaccggtgcctggaaaggctgatcgtggagaccggcagcgccgtgtctacagccaccgccgccagcgacgtgcagttcaagaggcccccaggctgcagagaactggtggaggacccttgcggcctgttccaggaagcctaccccatcacctgcgcctctgatcctgccctgctgcggagcgctagagatggcgaggcccacgccagggaaacccacttcacccagtacctgatctacgacgccagccccctgaagggcctgagcctgtga

SEQ ID NO: 6 - protein, 1374 aa, Artificial Sequence
  Synthetic
MAAPARDPPGYRYAAAILPTGSILSTIEVASHRRLFDFFAAVRSDENSLYDVEFDALLGSYCNTLSLVRFLELGLSVACVCTKFPELAYMNEGRVQFEVHQPLIARDGPHPVEQPVHNYMTKVIDRRALNAAFSLATEAIALLTGEALDGTGISLHRQLRAIQQLARNVQAVLGAFERGTADQMLHVLLEKAPPLALLLPMQRYLDNGRLATRVARATLVAELKRSFCDTSFFLGKAGHRREAIEAWLVDLTTATQPSVAVPRLTHADTRGRPVDGVLVTTAAIKQRLLQSFLKVEDTEADVPVTYGEMVLNGANLVTALVMGKAVRSLDDVGRHLLDMQEEQLEANRETLDELESAPQTTRVRADLVAIGDRLVFLEALERRIYAATNVPYPLVGAMDLTFVLPLGLFNPAMERFAAHAGDLVPAPGHPEPRAFPPRQLFFWGKDHQVLRLSMENAVGTVCHPSLMNIDAAVGGVNHDPVEAANPYGAYVAAPAGPGADMQQRFLNAWRQRLAHGRVRWVAECQMTAEQFMQPDNANLALELHPAFDFFAGVADVELPGGEVPPAGPGAIQATWRVVNGNLPLALCPVAFRDARGLELGVGRHAMAPATIAAVRGAFEDRSYPAVFYLLQAAIHGNEHVFCALARLVTQCITSYWNNTRCAAFVNDYSLVSYIVTYLGGDLPEECMAVYRDLVAHVEALAQLVDDFTLPGPELGGQAQAELNHLMRDPALLPPLVWDCDGLMRHAALDRHRDCRIDAGGHEPVYAAACNVATADFNRNDGRLLHNTQARAADAADDRPHRPADWTVHHKIYYYVLVPAFSRGRCCTAGVRFDRVYATLQNMVVPEIAPGEECPSDPVTDPAHPLHPANLVANTVKRMFHNGRVVVDGPAMLTLQVLAHNMAERTTALLCSAAPDAGANTASTANMRIFDGALHAGVLLMAPQHLDHTIQNGEYFYVLPVHALFAGADHVANAPNFPPALRDLARDVPLVPPALGANYFSSIRQPVVQHARESAAGENALTYALMAGYFKMSPVALYHQLKTGLHPGFGFTVVRQDRFVTENVLFSERASEAYFLGQLQVARHETGGGVNFTLTQPRGNVDLGVGYTAVAATGTVRNPVTDMGNLPQNFYLGRGAPPLLDNAAAVYLRNAVVAGNRLGPAQPLPVFGCAQVPRRAGMDHGQDAVCEFIATPVATDINYFRRPCNPRGRAAGGVYAGDKEGDVIALMYDHGQSDPARPFAATANPWASQRFSYGDLLYNGAYHLNGASPVLSPCFKFFTAADITAKHRCLERLIVETGSAVSTATAASDVQFKRPPGCRELVEDPCGLFQEAYPITCASDPALLRSARDGEAHARETHFTQYLIYDASPLKGLSL

SEQ ID NO: 7 - DNA, 2094 bp, Artificial Sequence
  Synthetic
atgtctgtgagaggacacgccgtgagaagaagaagagccagcaccagatctcatgccccatctgcccacagagctgatagccctgtggaggatgaacctgaaggcggcggagtgggactgatgggatacctgcgggccgtgttcaacgtggacgacgattctgaagtggaagccgctggcgaaatggcctctgaggaaccccctcctcggagaagaagagaggctagaggccaccctggaagcagaagagcctctgaagccagagctgctgcccctcctagaagagctagcttccccagacctagaagcgtgacagccagatcccagagcgtgagaggcagaagagatagcgccatcaccagagcccctagaggcggatatctgggccccatggaccctagagatgtgctgggaagagtgggcggatctagagtggtgcctagccccctgtttctggacgagctgaactacgaagaggacgattatcctgccgccgtggcccatgatgatggacctggcgccagaccttctgccacagtggagatcctggccggaagagtgtctggacctgaactgcaggccgccttccctctggatagactgacacctagagtggccgcctgggatgagtctgtgagatctgccctggctctgggacatccagccggcttttacccttgtcccgatagcgcctttggcctgtctagagtgggcgtgatgcactttgctagccctgccgaccctaaggtgttcttcaggcagacactgcagcagggcgaagctctggcttggtacgtgacaggcgacgccattctggatctgaccgacagaagagccaagaccagcccttctagagccatgggctttctggtggacgccattgtgagagtggccatcaatggatgggtgtgcggcacaagactgcacacagagggcagaggctctgagctggatgatagagccgccgaactgagaaggcagtttgcctctctgacagccctgagacctgtgggagctgctgctgtgcctctgctgtctgctggcggagctgctcctcctcatcctggacctgatgccgccgtgtttagaagcagcctgggcagcctgctgtattggcctggcgtgagagccctgctgggcagagattgtagagtggctgccagatacgcaggcaggatgacctatattgccacaggcgccctgctggctagattcaatcctggcgccgtgaaatgtgtgctgcctagggaagccgcttttgctggcagagtgctggatgtgctggccgtgctggctgaacagacagtgcagtggctgtctgtggtggtgggagctagactgcatcctcactctgcccatcctgcctttgccgatgtggaacaggaagccctgtttagagccctgccactgggatctccaggcgtggtggccgctgaacatgaagctctgggcgatacagctgctagaaggctgctggccacatctggactgaatgccgtgctgggagccgctgtgtatgctctgcataccgccctggctacagtgacactgaagtacgccctggcctgtggagatgctagaagaaggcgggacgacgctgctgctgctagggctgtgctggctacaggactgatcctgcagagactgctgggactggctgatacagtggtggcttgtgtggccctggctgcttttgatggcggaagcacagctcctgaagtgggcacctacacccctctgagatacgcctgtgtgctgagagctacccagcctctgtacgccagaacaacccctgccaagttctgggctgatgtgagagccgctgccgaacatgtggatctgagacctgcctcttctgctcctagagcccctgtgtctggaactgccgatccagccttcctgctggaagatctggccgcttttcctcctgcccctctgaatagcgagtctgtgctgggccctagagtgagagtggtggacatcatggcccagttccggaaactgctgatgggcgatgaagaaacagccgccctgagagcccacgtgtcaggaagaagagctacaggcctgggaggacctcctagaccttgatga

SEQ ID NO: 8 - protein, 696 aa, Artificial Sequence
  Synthetic
MSVRGHAVRRRRASTRSHAPSAHRADSPVEDEPEGGGVGLMGYLRAVFNVDDDSEVEAAGEMASEEPPPRRRREARGHPGSRRASEARAAAPPRRASFPRPRSVTARSQSVRGRRDSAITRAPRGGYLGPMDPRDVLGRVGGSRVVPSPLFLDELNYEEDDYPAAVAHDDGPGARPSATVEILAGRVSGPELQAAFPLDRLTPRVAAWDESVRSALALGHPAGFYPCPDSAFGLSRVGVMHFASPADPKVFFRQTLQQGEALAWYVTGDAILDLTDRRAKTSPSRAMGFLVDAIVRVAINGWVCGTRLHTEGRGSELDDRAAELRRQFASLTALRPVGAAAVPLLSAGGAAPPHPGPDAAVFRSSLGSLLYWPGVRALLGRDCRVAARYAGRMTYIATGALLARFNPGAVKCVLPREAAFAGRVLDVLAVLAEQTVQWLSVVVGARLHPHSAHPAFADVEQEALFRALPLGSPGVVAAEHEALGDTAARRLLATSGLNAVLGAAVYALHTALATVTLKYALACGDARRRRDDAAAARAVLATGLILQRLLGLADTVVACVALAAFDGGSTAPEVGTYTPLRYACVLRATQPLYARTTPAKFWADVRAAAEHVDLRPASSAPRAPVSGTADPAFLLEDLAAFPPAPLNSESVLGPRVRVVDIMAQFRKLLMGDEETAALRAHVSGRRATGLGGPPRP

SEQ ID NO: 9 - DNA, 37229 bp, Gorilla beringei beringei
catcatcaataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcaccgtcatttgacgcggagggtatttaaacccgctgcgctcctcaagaggccactcttgagtgccagcgagaagagttttctcctctgctccgcttcggtgatcgaaaaatgagacacatagcctgcactccgggtcttttgtccggtcgggcggcggccgagcttttggacgctttgatcaatgatgtcctaagcgatgattttccgtctactacccactttagcccacctactcttcacgaactgtacgatctggatgtactggtggatgtgaacgatcccaacgaggaggcggtttctgcgttttttcccgagtctgcgctgttggccgctcaggagggatttgacctacacactccgccgcctattttagagtctccgctgccggagcccagtggtataccttatatgcctgaactgcttcccgaagtggtagacctgacctgccacgagcctggctttccgcccagcgacgatgagggtgagccttttgttttagactttgctgagatacctgggcacggttgcaggtcttgtgcatatcatcagagggttaccggagaccccgaggttaagtgttcgctgtgctatatgaggatgacctcttcctttatctacagtaagtttttgtctaggtgggcttttgggtaggtgggttttgtgtcagaacaggtgtaaacgttgcttgtgttttttgtacctgtaggtccggtgtccgagccagacccggagcccgaccgcgatcccgagccggatcccgagcctcctcgcaggacaaggaaactaccttccattctgtgcaagtctcagacacctgtaaggaccagcgaggcagacagcaccgactctggcacttctacctctccccctgaaattcacccagtggttcctctgggtatacataaacctgttgctgttaaagtttgcgggcgacgccctgcagtacagtgcattgaggacttgcttcacgatcccgaggaacctttggacttgagccttaaacgccctaggcaataaaccccacctaagtaataaaccccacctaagtaataaaccctgccgcccttggttattgagatgacgcccaatgtttgcttttgaatgacttcatgtgtgtaataaaagtgagtgtgatcataggtctcttgtttgtctgggcggggcttaagggtatataagtctcttggggctaaacttggttacacttgaccccaatggaggcgtgggggtgcttggaggagtttgcggacgtgcgccgtttgctggacgagagctctagcaatacctatactatttggaggtatctgtggggctctactcaggccaagttggtttccagaattaagcaggattacaagtgcgattttgaagagctttttagttcctgcggtgagcttttgcaatccttgaatctgggccatcaggctattttccaggaaaaggttctctcgactttggatttttccactcccgggcgcaccgccgcttgtgtggcttttgtgtcttttgtgcaagataaatggagcgaggagacccacctgagtcacggctacgtactggatttcatggcgatggctctttggagggctcacaacaaatggaagattcagaaggaactgtacggttccgccctacgtcgtccacttctgtcgcgacaggggctgaggtttcccgaccatcggcagcatcagaatctggaagacgagtcggaggagcgagcggaggagaagatcagcttgagagccggcctggaccctcctcaggaggaatgaatctcccgcaggtggttgacctgtttccagaactgagacgggtcctgactatcagggaggatggtcagtttgtgaagaagtttaagagggatcggggtgagggagatgatgaggcggctagcaatttagcttttagtctgatgactcgccaccgaccggaatgtattacctatcagcagattaaggagagttgtgccaacgagctggatcttttgggtcagaagtatagcatagaacagcttaccacttactggcttcagcctggggatgattgggaagaggcgatcagggtgtatgcaaaggtggccctgcggcccgattgcaagtataagattactaagttggttaatattagaaactgctgctatatttctgggaacggggccgaagtggagatagatactcaggacagggtggcttttaggtgttgcatgataaacatgtggcccgggatactggggatggatggggtggtattcatgaatgtgaggtttacgggccccaactttaatggcacggtgttcatgggcaacaccaacttgctcctgcatggtgcgagtttctatgggtttaataacacctgtatagaggcctggaccgatgtaaaggttcgaggttgttccttttatagctgttggaaggcggtggtgtgtcgccctaaaagcaggggttctgtgaaaaaatgcttgtttgaaaggtgcaccttaggcatcctctctgagggcaactccagggtgcgccataatgtggcttcgaactgcggttgcttcatgcaagtgaagggggtgagcgttatcaagcataactcggtgtgtggaaactgcgaggatcgcgcctcccagatgctgacctgctttgatggcaactgtcacctgttgaagaccattcatataagcagccaccccagaaaggcctggcccgtgtttgagcataacatcttgacccgctgctccttgcatctgggggtcaggaggggtatgttcctgccttaccagtgtaactttagccacactaaaatcctgctggaacccgagtgcatgaccaaggtcagcctgaatggtgtgtttgatgtgactctgaaaatctggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgcaccagggccgagtttgggtctagcgatgaggataccgattgaggtgggtaaggtgggcgtggctagaagggtggggcgtgtataaattgggggtctaagggtctctctgttttgtcttgcaacagccgccgccatgagcgacaccggcaacagctttgatggaagcatctttagcccctatctgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcggcgcggcctctcgcgcgtctgctcgggatgagaaactgaccgctctgctgcttaaactggaagacttgacccgggagctgggtcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataggacatctttacgaatcgggggcggagggtcccggactgggggatgatggtaccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagcctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcgccctttcatcttcactctcttccgcatcgctgtctgcgagggccagctgctggggtaagtattccctctcgaaggcgggcatgacctcagcgctcaggttgtcagtttctaaaaatgaggaggatttgatgttcacctgtccggaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggattaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaaggaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacaggcatgggcggcaggggcacgtcttcgccgcgcgcgggcaggggctggtgctggctccgaagagcgcttgcgtgcgcgacgacgcgacggttggtgtcctgtatctgacgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcttcctggagatctcctcgtccggcgcgctccacggtggccgccaggtcgttggagatgcgacccatgagctgtgagaaggcgttgagcccgccctcgttccagacccggctgtagaccacgcccccctcggcgtcgcgagcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgttgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgagcggccgtgaggtagcgagacggcgctgactatgcatcttaacaattgctgtgtaggtacaccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcatgaggcggtggtatccgtagatgtacctggacatccaggtgatgccggcggcggtggtggtggcgcgcgcgtagtcgcggacccggttccagatgtttcgcaggggcgagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttgaatcggccggaaccgcggctaacgagggccgtggcagccccgtcctcaggaccccgccagccgacttctccagttacgggagcgagccccttttgttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtaaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggccgatgaccaggaagaggaggactatgagctagaggagggcgagtacctggaggactgacctggctggtggtgttttggtatagatgcaagatccgaacgtggcggacccggcggtccgggcggcgctgcaaagccagccgtccggcattaactcctctgacgactgggccgcggccatgggtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggacgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttcaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggagacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacccaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgtttatcaaccgcctgatggactacttgcatcgggcggcggccgtgaaccccgagtacttcactaatgccattctgaatccccactggatgccccctccgggtttctacaacggggactttgaggtgcccgaggtcaacgacgggttcctctgggatgacatggatgacagtgtgttctcacccaacccgctgcgcgccgcgtctctgcgattgaaggagggctctgacagggaaggaccgaggagtctggcctcctccctggctctgggagcggtgggcgccacgggcgcggcggcgcggggcagtagccccttccccagcctggcagactctctgaacagcgggcgggtgagcaggccccgcttgctaggcgaggaggagtatctgaacaactccctgctgcagcccgcgagggacaagaacgctcagcggcagcagtttcccaacaatgggatagagagcctggtggacaagatgtccagatggaagacgtatgcgcaggagtacaaggagtgggaggaccgccagccgcggcccttgccgccccctaggcagcgctggcagcggcgcgcgtccaaccgccgctggaggcaggggcccgaggacgatgatgactctgcagatgacagcagcgtgttggacctgggcgggagcgggaaccccttttcgcacctgcgcccacgcctgggcaagatgttttaaaagaaaaaaaaaataaaactcaccaaggccatggcgacgagcgttggttttttgttcccttccttagtatgcggcgcgcggcgatgttcgaggaggggcctcccccctcttacgagagcgcgatggggatttctcctgcggcgcccctgcagcctccctacgtgcctcctcggtacctgcaacctacaggggggagaaatagcatctgttactctgagctgcagcccctgtacgataccaccagactgtacctggtggacaacaagtccgcggacgtggcctccctgaactaccagaacgaccacagcgattttttgaccacggtgatccaaaacaacgacttcaccccaaccgaggccagcacccagaccataaacctggataacaggtcgaactggggcggcgacctgaagaccatcttgcacaccaacatgcccaacgtgaacgagttcatgttcaccaactcttttaaggcgcgggtgatggtggcgcgcgagcagggggaggcgaagtacgagtgggtggacttcacgctgcccgagggcaactactcagagaccatgactctcgacctgatgaacaatgcgatcgtggaacactatctgaaagtgggcaggcagaacggggtgaaggaaagcgatatcggggtcaagtttgacaccagaaacttccgtctgggctgggaccccgtgaccgggctggtcatgccgggggtctacaccaacgaggcctttcatcccgacatagtgcttctgcccggctgtggggtggacttcacccagagccggctgagcaacctgctgggcattcgcaagcggcagcctttccaggagggtttcaagatcacctatgaggatctgaaggggggcaacattcccgcgctccttgatctggacgcctacgaggagagcttgaaacccgaggagagcgctggcgacagcggcgagagtggcgaggagcaagccggcggcggtggcggcgcgtcggtagaaaacgaaagtacgcccgcagtggcggcggacgctgcggaggtcgagccggaggccatgcagcaggacgcagaggagggcgcacaggagggcgcgcagaaggacatgaacgatggggagatcaggggagacacattcgccacccggggcgaagaaaaagaggcagaggcggcggcggcggcgacggcggaggccgaaaccgaggttgaggcagaggcagagcccgagaccgaagttatggaagacatgaatgatggagaacgtaggggcgacacgttcgccacccggggcgaagagaaggcggcggaggcagaagccgcggctgaggaggcggctgcggctgcggccaagactgaggctgcggctaaggctgaggtcgaagccaatgttgcggttgaggctcaggctgaggaggaggcggcggctgaagcagttaaggaaaaggcccaggcagagcaggaagagaaaaaacctgtcattcaacctctaaaagaagatagcaaaaagcgcagttacaacgtcatcgagggcagcacctttacccagtaccgcagctggtacctggcgtacaactacggcgacccggtcaagggggtgcgctcgtggaccctgctctgcacgccggacgtcacctgcggctccgagcagatgtactggtcgctgccgaacatgatgcaagacccggtgaccttccgctccacgcggcaggttagcaacttcccggtggtgggcgccgaactgctgcccgtgcactccaagagtttttacaacgagcaggccgtctactcccagctgatccgccaggccacctctctgacccacgtgttcaatcgctttcccgagaaccagattttggcgcgcccgccggcccccaccatcaccaccgtgagtgaaaacgttcctgccctcacagatcacgggacgctaccgctgcgcaacagcatctcaggagtccagcgagtgaccattactgacgccagacgccggacctgcccctacgtttacaaggccttgggcatagtctcgccgcgcgtcctctccagtcgcactttttaaaacacatctacccacacgttccaaaatcatgtccgtactcatctcacccagcaacaacaccggctgggggctgcgcgcgcccagcaagatgtttggaggggcgaggaagcgctccgaccagcaccctgtgcgcgtgcgcggccactaccgcgcgccctggggagcgcacaagcgcgggcgcacagggcgcaccactgtggacgacgtcattgactccgtagtggagcaagcgcgccactacacacccggcgcgccgaccgcccccgccgtgtccaccgtggaccaggcgatcgaaagcgtggtacagggcgcgcggcactatgccaaccttaaaagtcgccgccgccgcgtggcccgccgccatcgccggagaccccgggccaccgccgccgcgcgccttactaaggctctgctcaggcgcgccaggcgaactggccaccgggccgccatgagggccgcacggcgggctgccgctgccgcaagcgtcgtggccccgcgggcacgaaggcgcgcggccgctgccgccgccgccgccatttccagcttggcctcgacgcggcgcggtaacatatactgggtgcgcgactcggtaaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgacgaggcggtggagtttgtccgccgcatggcacccaggcgccccgtgcagtggaagggccggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtaaccctgcaacaggtgctgcctttgagcgcgcccagcgagcataagcgagggttgaagcgcgaaggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcggcggccagcgccaccaccggcaccgcttcggtagaggtgcagacggacccctggctacccgccaccgctgttgccgccgccgccccccgttcgcgcgggcgcaagagaaattatccagcggccagcgcgctcatgccccagtacgcactgcatccatccatcgtgcccacccccggctaccgcgggtactcgtaccgcccgcgcagatcagccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcattttttggaggaaaaataaaaaaaagtctagactctcacgctcgcttggtcctgtgactattttgtagaaaaaaagatggaagacatcaactttgcgtcgctggccccgcgtcacggctcgcgcccgttcatgggagactggacagatatcggcaccagcaatatgagcggtggcgccttcagctggggcagtctgtggagcggccttaaaaattttggttccaccattaagaactatggcaacaaagcgtggaacagcagcacgggccagatgctgagagacaagttgaaagagcagaacttccaggagaaggtggcgcagggcctggcctctggcatcagcggggtggtggacatagctaaccaggccgtgcagaaaaagataaacagtcatctggacccccgtcctcaggtggaggaaatgcctccagcgatggagacggtgtctcccgagggcaaaggcgaaaagcgcccgcggcccgacagagaagagaccctggtgtcacacaccgaggagccgccctcttacgaggaggcagtcaaggccggcctgcccaccactcgccccatagcccccatggccaccggtgtggtgggccacaggcaacacactcccgcaacactagatctgcccccgccgtccgagccgccgcgccagccaaaggcggcgacggtgcccgctccctccacttccgccgccaacagagtgcccctgcgccgcgccgcgagcggcccccgggcctcgcgagttagcggcaactggcagagcacactgaacagcatcgtgggcctgggagtgaggagtgtgaagcgccgccgttgctactgaatgagcaagctagctaacgtgttgtatgtgtgtatgcgtcctatgtcgccgccagaggagctgttgagccgccggcgccgtctgcactccagcgaatttcaagatggcgaccccatcgatgatgcctcagtggtcgtacatgcacatctcgggccaggacgcttcggagtacctgagccccgggctggtgcagttcgcccgcgccacagacacctacttcaacatgagtaacaagttcaggaaccccactgtggcgcccacccacgatgtgaccacggaccggtcgcagcgcctgacgctgcggttcatccccgtggatcgggaggacaccgcctactcttacaaggcgcggttcacgctggccgtgggcgacaaccgcgtgctggacatggcctccacttactttgacatcaggggggtgctggacaggggccccaccttcaagccctactcgggtactgcctacaactccctggcccccaagggcgctcccaattcttgcgagtgggaacaagatgaaccagctcaggcagcaatagctgaagatgaagaagaacttgaagaagaacaagctcaggacgaacaggcgcccactaagaaaacccatgtatacgcccaggcacctctttctggtgaaaaaattactaaggatggtttgcaaataggtgtggatgccacacaggcgggagataaccctatatatgctgataaaacattccaacccgaacctcagataggtgagtctcagtggaacgaggctgatgccacagtagcaggaggcagagtcttaaaaaagaccacccctatgagaccttgctatggatcctatgccaaacctactaatgccaatggcggtcaagggatcatggtggccaatgatcagggagcgcttgaatctaaagttgagatgcaatttttctccaccacaacgtctcttaatgtaagggaaggtgaaaacaatcttcagccaaaagtagtgctatacagcgaagatgttaacttggaatcccctgacactcatttgtcttacaaacctaaaaaggatgacaccaactctaaaatcatgttgggtcagcaagccatgcccaacagacccaacctcattgcttttagggacaactttattggacttatgtactacaacagcacaggcaacatgggagtgctggcaggacaggcctcccagctaaacgctgtggtagacttgcaagacagaaacacagagctgtcataccaactgatgcttgattccattggagacagatcaagatacttttccatgtggaaccaggcagtggacagctatgacccagatgtcagaatcattgaaaaccatggggttgaagatgagctgcccaactattgctttcccctgggcggtattggaattacagacacataccagtgcataaaaccaaccgcagctgctaataacactacatggtctaaggatgaagaatttagtgatcgcaatgaaataggggtgggaaacaacttcgccatggagatcaacatccaggccaacctctggaggaacttcctctatgcgaacgtggggctctacctgccagacaagctcaagtacaaccccaccaacgtggacatctctgacaaccccaacacctatgactacatgaacaagcgtgtggtggctcccggcctggtggactgctttgtcaatgtgggagccaggtggtccctggactacatggacaacgtcaaccccttcaaccaccaccgcaatgcgggtctgcgctaccgctccatgatcctgggcaacgggcgctacgtgcccttccacattcaggtgccccagaagttctttgccatcaagaacctcctcctcctgccgggctcctacacttacgagtggaacttcaggaaggatgtcaacatggtcctgcagagctctctgggcaatgaccttagggtggacggggccagcatcaagtttgacagcgtcaccctctatgctaccttcttccccatggctcacaacaccgcctccacgctcgaggccatgctgaggaacgacaccaacgaccagtccttcaatgactacctctctggggccaacatgctctaccccatccccgccaaggccaccaacgtgcccatctccattccctctcgcaactgggccgccttcagaggctgggcctttacccgccttaagaccaaggaaaccccctccctgggctcgggttttgacccctactttgtctactcgggatccatcccctacctggatggcaccttctacctcaaccacacttttaagaagatatccatcatgtatgactcctccgtcagctggccgggcaatgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccattggcatcactcaccagcacaacaactcgggattcgtgggctacctggctcccaccatgcgcgaggggcaggcctaccccgccaacttcccctacccgttgataggcaaaaccgcggtcgacagcgtcacccagaaaaagttcctctgcgaccgcaccctctggcgcatccccttctctagcaacttcatgtccatgggtgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacctgctacctcttcgacccctttggcttctccgatcagcgcctcagacagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcacatccggggggccacctctttctgccacttgcaagaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttaaactcgggcaccaccatgcggggcagtggttcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattatgcacgctggccagcaggctctcgtcgctgatcatgtcgctgtccagatcctccgcgttgctcagggcgaacggggtcatcttgcagacctgcctgcccaggaaaggcggcagcccgggcttgccgttgcagtcgcagcgcaggggcatcagcaggtgcccgcggcccgactgcgcctgcgggtacagcgcgcgcatgaaggcttcgatctgcctgaaagccacctgcgtcttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtaccgtgcagacacttcaggtcgccctccgtctgggtgcagcggtgctcccacagcgcgcaaccggtgggctcccaatttttgtgggtcacccccgcgtaggcctgcaggtaggcctgcaagaagcgccccatcatggccacaaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagcgccgcctgctcttcttcgtcttcgctgtctaccactatctctggggaagggcttctccgctctgcggcggcgcgcttcttttttttcttgggagcggccgtgatggagtccgccacggcgacggaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcttctcgagctggtcttggtcccgactggccattgtatcctcctcctcctaggcagagagacataaggagtctatcatgcaagtcgagaaggaggagagcttaaccaccccctctgagaccgccgatgcgcccgccgtcgccgtcgcccccgctgccgccgacgcgcccgccacaccgagcgacacccccgcggacccccccgccgacgcacccctgttcgaggaagcggccgtggagcaggacccgggctttgtctcggcagaggaggatttgcgagaggaggaggataaggagaagaagccctcagtgccaaaagatgataaagagcaagacgagcacgacgcagatgcacaccagggtgaagtcgggcggggggacggagggcatgacggcgccgactacctagacgaagggaacgacgtgctcttgaagcacctgcatcgtcagtgcgccattgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgcctttgtggtacccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtaccaaagatcttcgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctaaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgtggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgcctggaggagcgcaacctcaaggagctggagaagctcctgcagcgcgcgctcaaagatctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaagaccaatcccgcccgcccaaggcggagctgaccgcctgcgtcatcacccagggcgagatcctaggccaattgcaagccatccaaaaagcccgccaagactttttgctgaagaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcaattaccaccacgccccgcaataatcccaaccccagggagtggcccgcgtccctggtgtatcaggaaattcccggccccaccaccgtactacttccgcgtgattcccaggccgaagtccaaatgactaactcaggggcacagctcgcgggcggctgtcgtcacagggtgcggcctcctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcaaagctcgtcctcggcgccgcgctcgggcggcatcgggactctccagttcgtgcaggagtttgtgccctcggtctacttcaaccccttctcgggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgaggaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacgagagttaacacttgtggggtttctggtgtatgtgacgctggtggtggctcttttgattaaggcttttccttccatgtctgaactctccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgactttatagagccccagtgtaatgtgacttttaaagcccatgcacagcgttgtcatactataatcaaatgtgccaccgaacacgatgaataccttatccagtataaagataaatcacacaaagtggcacttgttgacatctggaaacccgaagaccctttggaatacaatgtgaccgttttccagggtgacctcttcaaaatttacaattacactttcccatttgaccagatgtgtgactttgtcatgtacatggaaaagcagcacaagctgtggcctccgactccccagggctgtgtggaaaatccaggctctttctgcatgatctctctctgtgtaactgtgctggcactaatactcacgcttttgtatatcagatttaaatcaaggcaaagcttcattgatgaaaagaaaatgccttaatcgctttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaatagccacaagcccagagccatctgcgatgggcaaaatctaaccttgattgatgttcaattgctggatgcgggctactattatgggcagctgggtacaatgattaattactggagaccccacagagattacatgctccacgtagtaaagggtccccttagcagcccacccactaccacctctactacccccactaccaccactactcccaccaccagcactgccgcccagcctcctcatagcagaacaaccacttttatcaattccaagtcccactccccccacattgccggcgggccctccgcctcagactccgaaaccaccgagatctgcttctgcaaatgctctgacgccattgcccaggatttggaagatcacgaggaagatgagcatgacttcgcagatgcatgccaggcatcagagccagaagcgctgccggtggccctcaaacagtatgcagacccccacaccacccccgaccttcctccaccttcccagaagccaagtttcctgggggaaaatgaaactctgcctctctccatactcgctctgacatctgttgctatgttgaccgctctgctggtgcttctatgctctatatgctacctgatctgctgcagaaagaaaaaatctcacggccatgctcaccagcccctcatgcacttcccttaccctccagagctgggcgaccacaaactttaagtctgcagtaactatctgcccatcccttgtcagtcgacagcgatgagccccactaatctaacggcctctggacttacaacatcgtctcttaatgagaccaccgctcctcaagacctgtacgatggtgtctccgcgctggttaaccagtgggatcacctgggcatatggtggctcctcataggagcagtgaccctgtgcctaatcctggtctggatcatctgctgcatcaaaagcagaagacccaggcggcggcccatctacaggccctttgtcatcacacctgaagatgatgatgacaccacttccaggctgcagaggctaaagcagctactcttctcttttacagcatggtaaattgaatcatgcctcgcattttcatctacttgtctctccttccactttttctgggctcttctacattggccgctgtgtcccacatcgaggtagactgcctcacgcccttcacagtctacctgcttttcggctttgtcatctgcacctttgtctgcagcgttatcactgtagtgatctgcttcatacagtgcatcgactacgtctgcgtgcgggtggcttactttagacaccacccccagtatcgcaacagggacatagcggctctcctaagacttgtttaaaatcatggccaaattaactgtgattggtcttctgatcatctgctgcgtcctagccgcgattgggactcaagctcctaccaccaccagcgctcccagaaagagacatgtatcctgcagcttcaagcgtccctggaatataccccaatgctttactgatgaacctgaaatctctttggcttggtacttcagcgtcaccgcccttcttatcttctgcagtacggttattgcccttgccatctacccttcccttgacctgggctggaatgctgtcaactctatggaatatcccaccttcccagaaccagacctgccagacctggttgttctaaacgcgtttcctcctcctgctcccgttcaaaatcagtttcgccctccgtcccccacgcccactgaggtcagctactttaatctaacaggcggagatgactgaaaacctagacctagaaatggacggtctctgcagcgagcaacgcacactagagaggcgccggcaaaaagagctcgagcgtcttaaacaagagctccaagacgcggtggccatacaccagtgcaaaaaaggtgtcttctgtctggtaaaacaggccacgctcacctatgaaaaaacaggtgacacccaccgcctaggatacaagctgcccacacagcgccaaaagttcgccctcatgataggcgaacaacccatcaccgtgacccagcactccgtggagacagaaggctgcatacatgctccctgtaggggcgctgactgcctctacaccttgatcaaaaccctctgcggtctcagagaccttatccctttcaattaatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtccctttccttacccctccctttgtgtcatccgcaggaatgcaagaaaatccagctggggtgctgtccctgcacttgtcagagccccttaccacccacaatggggccctgactctaaaaatggggggcggcctgaccctggacaaggaagggaatctcacttcccaaaacatcaccagtgtcgatccccctctcaaaaaaagcaagaacaacatcagccttcagaccgccgcacccctcgccgtcagctccggggccctaacactttttgccactccccccctagcggtcagtggtgacaaccttactgtgcagtctcaggcccctctcactttggaagactcaaaactaactctggccaccaaaggacccctaactgtgtccgaaggcaaacttgtcctagaaacagaggctcccctgcatgcaagtgacagcagcagcctgggccttagcgttacggccccacttagcattaacaatgacagcctaggactagatctgcaggcacccattgtctctcaaaatggaaaactggctctaaatgtagcaggccccctagctgtggccaatggcattaatgctttgacagtaggcacaggcaaaggtattggtctaaatgaaaccagcactcacttgcaagcaaagttggtcgcccccctaggctttgataccaatggcaacattaagctaagcgttgcaggaggcatgagactaaataatgacacacttatactagatgtaaactacccatttgaagctcaaggccaactaagtctaagagtgggccagggtccgctgtatgtagattctagcagccataacctgaccattagatgccttagaggattatacataacatcgtctaataaccaaaccggtctagaggccaacataaaactaacaaaaggccttgtctatgatggaaatgccatagcagtcaatgttggtcaaggattgcaatacagcactactgccacatcggaaggtgtgtatcctatacagtctaagataggtttgggaatggaatatgataccaacggagccatgatgacaaaactaggctctggactaagctttgacaattcaggagccattgtagtgggaaacaaaaatgatgacaggcttactctgtggactacaccagacccatctcctaactgtagaatttattctgaaaaagatactaaactaaccttggtgctgactaagtgtggcagccaaatcctaggcacagtatctgcccttgctgtcagaggcagccttgcgcccatcactaatgcatccagcatagtccaaatatttctaagatttgatgaaaatggactattgatgagcaactcatcgctagacggtgattactggaattacagaaatggggactccactaatagcacaccatatacaaatgcagtaggctttatgcctaatctagcagcctatcctaaaggtcaggctacagctgcaaaaagcagtattgtaagccaggtatacatggatggtgacactactaaacctataacactaaaaataaacttcaatggcattgatgaaacaacagaaaatacccctgttagtaaatattccatgacattctcatggagctggcccaccgcaagctacataggccacacttttgcaacaaactcttttactttctcctacatcgcccaagaataaagaaagcacagagatgcttgttttgatttcaaaattgtgtgcttttatttattttcagcttacagtatttccagtagtcattcgaataaagcttaatcaaactgcatgagaacccttccacatagcttaaattagcaccagtgcaaatggagaaaattcaacataccttttttatccagatatcagagaactctagtggtcagttttcccccaccctcccagctcacagaatacacagtcctttccccccggctggctttaaacaacactatctcattggtaacagacatattcttaggtgtaataatccacacggtctcttggcgggccaagcgctggtcggtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgcagcaacaaggcgcgcagcaactcctgccgccgcctctccgtacgacaggaatgcaacggcgtggtggtctcctccgcgataatccgcaccgctcgcagcatcagcatcctcgtcctccgggcacagcagcgcatcctgatctcactgagatcggcgcagtaagtgcagcacaaaaccaagatgttatttaagatcccacagtgcaaagcactgtacccaaagctcatggcgggaaggacagcccccacgtgaccatcataccagatccttaggtaaatcaaatgacgacctctcataaacacgctggacatgtacatcacctccttgggcatgcgctgattcaccacctctcgataccacaagcatcgctgattaattaaagacccctcaagcaccatcctgaaccaggaagccagcacctgaccccccgccaggcactgcagggaccccggtgaattgcagtggcagtgaagactccagcgctcgtagccgtgaaccatagagccggtcattatatccacattggcacaacacaaacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagctcgcgtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgctcggtgtagtagttgtaatacagccactccctcagaccgtcaaggcgctccctggcgtccggatctataacaacaccgtcctgcagcgccgccctgatgacatccaccaccgtagagtatgccaagcccagccaggaaatgcattcactttgacagcgagagataggaggagcgggaagagatggaagaaccatgatagtaaaagacttttattccaatcgatcctctacaatgtcaaagtgtagatctataagatgacactggtctcctccgctgagtcgatcaaaaataacagctaaaccacaaacaacacgattggtcaaatgctccacaagggcttgcagcataaaatcgcctcgaaagtccaccgcaagcataacatcaaagccaccgcccctatcatgatctataataaaaaccccacagctatccaccagacccataaagttttcatctctccatcgtgaaaaaatatttacaagctcctcctttaaatcacctccaaccaattgaaaaagttgagccaaaccgccctccaccttcattttcagcaagcgcatcatgattgcaaaaattcaggctcctgagacacctgtataagattgagaagcggaacgttaacgtcaatgtttcgctcgcgaagatcgcgcctcagtgcaagcatgatataatcccacaggtcggagcggatcagcgaggacatctccccgccaggaaccaactcaacggagcctatgctgattataatacgcatattcggggctatgctgaccagcacggcccccaaataggcgtactgcataggcggcgacaaaaagtgaacagtttgggttaaaaaatcaggcaaacagtcgcgcaaaaaagcaagaacatcataaccatgctcatgcaaatagatgcaagtaagctcaggaacgaccacagaaaaatgcacaatttttctctcaaacatgactgcgagccctgcaaaaaataaaaaagaaacattacacaagagtagcctgtcttacgatgggatagactactctaaccaacataagacgggccacaacatcgcccgcgtggccataaaaaaaattgtccgtgtgattaaaaagaagcacagatagctggccagtcatatccggagtcatcacgtgtgaacccgtgtagacccccgggttggacacatcggccaaacaaagaaagcggccaatgtacccaggaggaatcataacactaagacgaagatacaacagaataaccccatgagggggaataacaaagttagtaggtgaataaaaacgataaacacccgaaactccctcctgcgtaggcaaaatagcaccctccccttccaaaacaacatatagcgcttccacagcagccatgacaaaagactcaaaacactcaaaagactcagtcttaccaggaaaataaaagcactctcacagcaccagcactaatcagagtgtgaagagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccggtttctcacggtacgtcacttccgcaagaaaagcaaaactacatttcccacatgtgtaaaaacgaaaccccgccccttgtaactgcccacaacttacatcatcaaaacataaactcctacgtcacccgccccgcctctccccgcccacctcattatcatattggccacaatccaaaataaggtatattattgatgatg

SEQ ID NO: 10 - DNA, 37232 bp, Gorilla beringei beringei
catcatcaataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcaccgtcatttgacgcggagggtatttaaacccgctgcgctcctcaagaggccactcttgagtgccagcgagaagagttttctcctctgctccgcttcggtgatcgaaaaatgagacacatagcctgcactccgggtcttttgtccggtcgggcggcggccgagcttttggacgctttgatcaatgatgtcctaagcgatgattttccgtctactacccactttagcccacctactcttcacgaactgtacgatctggatgtactggtggatgtgaacgatcccaacgaggaggcggtttctgcgttttttcccgagtctgcgctgttggccgctcaggagggatttgacctacacactccgccgcctattttagagtctccgctgccggagcccagtggtataccttatatgcctgaactgcttcccgaagtggtagacctgacctgccacgagcctggctttccgcccagcgacgatgagggtgagccttttgttttagactttgctgagatacctgggcacggttgcaggtcttgtgcatatcatcagagggttaccggagaccccgaggttaagtgttcgctgtgctatatgaggatgacctcttcctttatctacagtaagtttttgtctaggtgggcttttgggtaggtgggttttgtgtcagaacaggtgtaaacgttgcttgtgttttttgtacctgtaggtccggtgtccgagccagacccggagcccgaccgcgatcccgagccggatcccgagcctcctcgcaggacaaggaaactaccttccattctgtgcaagtctcagacacctgtaaggaccagcgaggcagacagcaccgactctggcacttctacctctccccctgaaattcacccagtggttcctctgggtatacataaacctgttgctgttaaagtttgcgggcgacgccctgcagtacagtgcattgaggacttgcttcacgatcccgaggaacctttggacttgagccttaaacgccctaggcaataaaccccacctaagtaataaaccccacctaagtaataaaccctgccgcccttggttattgagatgacgcccaatgtttgcttttgaatgacttcatgtgtgtaataaaagtgagtgtgatcataggtctcttgtttgtctgggcggggcttaagggtatataagtctcttggggctaaacttggttacacttgaccccaatggaggcgtgggggtgcttggaggagtttgcggacgtgcgccgtttgctggacgagagctctagcaatacctatactatttggaggtatctgtggggctctactcaggccaagttggtttccagaattaagcaggattacaagtgcgattttgaagagctttttagttcctgcggtgagcttttgcaatccttgaatctgggccatcaggctattttccaggaaaaggttctctcgactttggatttttccactcccgggcgcaccgccgcttgtgtggcttttgtgtcttttgtgcaagataaatggagcgaggagacccacctgagtcacggctacgtactggatttcatggcgatggctctttggagggctcacaacaaatggaagattcagaaggaactgtacggttccgccctacgtcgtccacttctgtcgcgacaggggctgaggtttcccgaccatcggcagcatcagaatctggaagacgagtcggaggagcgagcggaggagaagatcagcttgagagccggcctggaccctcctcaggaggaatgaatctcccgcaggtggttgacctgtttccagaactgagacgggtcctgactatcagggaggatggtcagtttgtgaagaagtttaagagggatcggggtgagggagatgatgaggcggctagcaatttagcttttagtctgatgactcgccaccgaccggaatgtattacctatcagcagattaaggagagttgtgccaacgagctggatcttttgggtcagaagtatagcatagaacagcttaccacttactggcttcagcctggggatgattgggaagaggcgatcagggtgtatgcaaaggtggccctgcggcccgattgcaagtataagattactaagttggttaatattagaaactgctgctatatttctgggaacggggccgaagtggagatagatactcaggacagggtggcttttaggtgttgcatgataaacatgtggcccgggatactggggatggatggggtggtattcatgaatgtgaggtttacgggccccaactttaatggcacggtgttcatgggcaacaccaacttgctcctgcatggtgcgagtttctatgggtttaataacacctgtatagaggcctggaccgatgtaaaggttcgaggttgttccttttatagctgttggaaggcggtggtgtgtcgccctaaaagcaggggttctgtgaaaaaatgcttgtttgaaaggtgcaccttaggcatcctctctgagggcaactccagggtgcgccataatgtggcttcgaactgcggttgcttcatgcaagtgaagggggtgagcgttatcaagcataactcggtgtgtggaaactgcgaggatcgcgcctcccagatgctgacctgctttgatggcaactgtcacctgttgaagaccattcatataagcagccaccccagaaaggcctggcccgtgtttgagcataacatcttgacccgctgctccttgcatctgggggtcaggaggggtatgttcctgccttaccagtgtaactttagccacactaaaatcctgctggaacccgagtgcatgaccaaggtcagcctgaatggtgtgtttgatgtgactctgaaaatctggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgcaccagggccgagtttgggtctagcgatgaggataccgattgaggtgggtaaggtgggcgtggctagaagggtggggcgtgtataaattgggggtctaagggtctctctgttttgtcttgcaacagccgccgccatgagcgacaccggcaacagctttgatggaagcatctttagcccctatctgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcggcgcggcctctcgcgcgtctgctcgggatgagaaactgaccgctctgctgcttaaactggaagacttgacccgggagctgggtcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataggacatctttacgaatcgggggcggagggtcccggactgggggatgatggtaccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagcctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcgccctttcatcttcactctcttccgcatcgctgtctgcgagggccagctgctggggtaagtattccctctcgaaggcgggcatgacctcagcgctcaggttgtcagtttctaaaaatgaggaggatttgatgttcacctgtccggaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggattaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaaggaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacaggcatgggcggcaggggcacgtcttcgccgcgcgcgggcaggggctggtgctggctccgaagagcgcttgcgtgcgcgacgacgcgacggttggtgtcctgtatctgacgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcttcctggagatctcctcgtccggcgcgctccacggtggccgccaggtcgttggagatgcgacccatgagctgtgagaaggcgttgagcccgccctcgttccagacccggctgtagaccacgcccccctcggcgtcgcgagcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgttgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgagcggccgtgaggtagcgagacggcgctgactatgcatcttaacaattgctgtgtaggtacaccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcatgaggcggtggtatccgtagatgtacctggacatccaggtgatgccggcggcggtggtggtggcgcgcgcgtagtcgcggacccggttccagatgtttcgcaggggcgagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttgaatcggccggaaccgcggctaacgagggccgtggcagccccgtcctcaggaccccgccagccgacttctccagttacgggagcgagccccttttgttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtaaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggccgatgaccaggaagaggaggactatgagctagaggagggcgagtacctggaggactgacctggctggtggtgttttggtatagatgcaagatccgaacgtggcggacccggcggtccgggcggcgctgcaaagccagccgtccggcattaactcctctgacgactgggccgcggccatgggtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggacgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttcaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggagacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacccaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgtttatcaaccgcctgatggactacttgcatcgggcggcggccgtgaaccccgagtacttcactaatgccattctgaatccccactggatgccccctccgggtttctacaacggggactttgaggtgcccgaggtcaacgacgggttcctctgggatgacatggatgacagtgtgttctcacccaacccgctgcgcgccgcgtctctgcgattgaaggagggctctgacagggaaggaccgaggagtctggcctcctccctggctctgggagcggtgggcgccacgggcgcggcggcgcggggcagtagccccttccccagcctggcagactctctgaacagcgggcgggtgagcaggccccgcttgctaggcgaggaggagtatctgaacaactccctgctgcagcccgcgagggacaagaacgctcagcggcagcagtttcccaacaatgggatagagagcctggtggacaagatgtccagatggaagacgtatgcgcaggagtacaaggagtgggaggaccgccagccgcggcccttgccgccccctaggcagcgctggcagcggcgcgcgtccaaccgccgctggaggcaggggcccgaggacgatgatgactctgcagatgacagcagcgtgttggacctgggcgggagcgggaaccccttttcgcacctgcgcccacgcctgggcaagatgttttaaaagaaaaaaaaaaataaaactcaccaaggccatggcgacgagcgttggttttttgttcccttccttagtatgcggcgcgcggcgatgttcgaggaggggcctcccccctcttacgagagcgcgatggggatttctcctgcggcgcccctgcagcctccctacgtgcctcctcggtacctgcaacctacaggggggagaaatagcatctgttactctgagctgcagcccctgtacgataccaccagactgtacctggtggacaacaagtccgcggacgtggcctccctgaactaccagaacgaccacagcgattttttgaccacggtgatccaaaacaacgacttcaccccaaccgaggccagcacccagaccataaacctggataacaggtcgaactggggcggcgacctgaagaccatcttgcacaccaacatgcccaacgtgaacgagttcatgttcaccaactcttttaaggcgcgggtgatggtggcgcgcgagcagggggaggcgaagtacgagtgggtggacttcacgctgcccgagggcaactactcagagaccatgactctcgacctgatgaacaatgcgatcgtggaacactatctgaaagtgggcaggcagaacggggtgaaggaaagcgatatcggggtcaagtttgacaccagaaacttccgtctgggctgggaccccgtgaccgggctggtcatgccgggggtctacaccaacgaggcctttcatcccgacatagtgcttctgcccggctgtggggtggacttcacccagagccggctgagcaacctgctgggcattcgcaagcggcagcctttccaggagggtttcaagatcacctatgaggatctgaaggggggcaacattcccgcgctccttgatctggacgcctacgaggagagcttgaaacccgaggagagcgctggcgacagcggcgagagtggcgaggagcaagccggcggcggtggcggcgcgtcggtagaaaacgaaagtacgcccgcagtggcggcggacgctgcggaggtcgagccggaggccatgcagcaggacgcagaggagggcgcacaggagggcgcgcagaaggacatgaacgatggggagatcaggggagacacattcgccacccggggcgaagaaaaagaggcagaggcggcggcggcggcgacggcggaggccgaaaccgaggttgaggcagaggcagagcccgagaccgaagttatggaagacatgaatgatggagaacgtaggggcgacacgttcgccacccggggcgaagagaaggcggcggaggcagaagccgcggctgaggaggcggctgcggctgcggccaagactgaggctgcggctaaggctgaggtcgaagccaatgttgcggttgaggctcaggctgaggaggaggcggcggctgaagcagttaaggaaaaggcccaggcagagcaggaagagaaaaaacctgtcattcaacctctaaaagaagatagcaaaaagcgcagttacaacgtcatcgagggcagcacctttacccagtaccgcagctggtacctggcgtacaactacggcgacccggtcaagggggtgcgctcgtggaccctgctctgcacgccggacgtcacctgcggctccgagcagatgtactggtcgctgccgaacatgatgcaagacccggtgaccttccgctccacgcggcaggttagcaacttcccggtggtgggcgccgaactgctgcccgtgcactccaagagtttttacaacgagcaggccgtctactcccagctgatccgccaggccacctctctgacccacgtgttcaatcgctttcccgagaaccagattttggcgcgcccgccggcccccaccatcaccaccgtgagtgaaaacgttcctgccctcacagatcacgggacgctaccgctgcgcaacagcatctcaggagtccagcgagtgaccattactgacgccagacgccggacctgcccctacgtttacaaggccttgggcatagtctcgccgcgcgtcctctccagtcgcactttttaaaacacatctacccacacgttccaaaatcatgtccgtactcatctcacccagcaacaacaccggctgggggctgcgcgcgcccagcaagatgtttggaggggcgaggaagcgctccgaccagcaccctgtgcgcgtgcgcggccactaccgcgcgccctggggagcgcacaagcgcgggcgcacagggcgcaccactgtggacgacgtcattgactccgtagtggagcaagcgcgccactacacacccggcgcgccgaccgcccccgccgtgtccaccgtggaccaggcgatcgaaagcgtggtacagggcgcgcggcactatgccaaccttaaaagtcgccgccgccgcgtggcccgccgccatcgccggagaccccgggccaccgccgccgcgcgccttactaaggctctgctcaggcgcgccaggcgaactggccaccgggccgccatgagggccgcacggcgggctgccgctgccgcaagcgtcgtggccccgcgggcacgaaggcgcgcggccgctgccgccgccgccgccatttccagcttggcctcgacgcggcgcggtaacatatactgggtgcgcgactcggtaaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgacgaggcggtggagtttgtccgccgcatggcacccaggcgccccgtgcagtggaagggccggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtaaccctgcaacaggtgctgcctttgagcgcgcccagcgagcataagcgagggttgaagcgcgaaggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcggcggccagcgccaccaccggcaccgcttcggtagaggtgcagacggacccctggctacccgccaccgctgttgccgccgccgccccccgttcgcgcgggcgcaagagaaattatccagcggccagcgcgctcatgccccagtacgcactgcatccatccatcgtgcccacccccggctaccgcgggtactcgtaccgcccgcgcagatcagccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcattttttggaggaaaaaataaaaaaaaagtctagactctcacgctcgcttggtcctgtgactattttgtagaaaaaaagatggaagacatcaactttgcgtcgctggccccgcgtcacggctcgcgcccgttcatgggagactggacagatatcggcaccagcaatatgagcggtggcgccttcagctggggcagtctgtggagcggccttaaaaattttggttccaccattaagaactatggcaacaaagcgtggaacagcagcacgggccagatgctgagagacaagttgaaagagcagaacttccaggagaaggtggcgcagggcctggcctctggcatcagcggggtggtggacatagctaaccaggccgtgcagaaaaagataaacagtcatctggacccccgtcctcaggtggaggaaatgcctccagcgatggagacggtgtctcccgagggcaaaggcgaaaagcgcccgcggcccgacagagaagagaccctggtgtcacacaccgaggagccgccctcttacgaggaggcagtcaaggccggcctgcccaccactcgccccatagcccccatggccaccggtgtggtgggccacaggcaacacactcccgcaacactagatctgcccccgccgtccgagccgccgcgccagccaaaggcggcgacggtgcccgctccctccacttccgccgccaacagagtgcccctgcgccgcgccgcgagcggcccccgggcctcgcgagttagcggcaactggcagagcacactgaacagcatcgtgggcctgggagtgaggagtgtgaagcgccgccgttgctactgaatgagcaagctagctaacgtgttgtatgtgtgtatgcgtcctatgtcgccgccagaggagctgttgagccgccggcgccgtctgcactccagcgaatttcaagatggcgaccccatcgatgatgcctcagtggtcgtacatgcacatctcgggccaggacgcttcggagtacctgagccccgggctggtgcagttcgcccgcgccacagacacctacttcaacatgagtaacaagttcaggaaccccactgtggcgcccacccacgatgtgaccacggaccggtcgcagcgcctgacgctgcggttcatccccgtggatcgggaggacaccgcctactcttacaaggcgcggttcacgctggccgtgggcgacaaccgcgtgctggacatggcctccacttactttgacatcaggggggtgctggacaggggccccaccttcaagccctactcgggtactgcctacaactccctggcccccaagggcgctcccaattcttgcgagtgggaacaagatgaaccagctcaggcagcaatagctgaagatgaagaagaacttgaagaagaacaagctcaggacgaacaggcgcccactaagaaaacccatgtatacgcccaggcacctctttctggtgaaaaaattactaaggatggtttgcaaataggtgtggatgccacacaggcgggagataaccctatatatgctgataaaacattccaacccgaacctcagataggtgagtctcagtggaacgaggctgatgccacagtagcaggaggcagagtcttaaaaaagaccacccctatgagaccttgctatggatcctatgccaaacctactaatgccaatggcggtcaagggatcatggtggccaatgatcagggagcgcttgaatctaaagttgagatgcaatttttctccaccacaacgtctcttaatgtaagggaaggtgaaaacaatcttcagccaaaagtagtgctatacagcgaagatgttaacttggaatcccctgacactcatttgtcttacaaacctaaaaaggatgacaccaactctaaaatcatgttgggtcagcaagccatgcccaacagacccaacctcattgcttttagggacaactttattggacttatgtactacaacagcacaggcaacatgggagtgctggcaggacaggcctcccagctaaacgctgtggtagacttgcaagacagaaacacagagctgtcataccaactgatgcttgattccattggagacagatcaagatacttttccatgtggaaccaggcagtggacagctatgacccagatgtcagaatcattgaaaaccatggggttgaagatgagctgcccaactattgctttcccctgggcggtattggaattacagacacataccagtgcataaaaccaaccgcagctgctaataacactacatggtctaaggatgaagaatttagtgatcgcaatgaaataggggtgggaaacaacttcgccatggagatcaacatccaggccaacctctggaggaacttcctctatgcgaacgtggggctctacctgccagacaagctcaagtacaaccccaccaacgtggacatctctgacaaccccaacacctatgactacatgaacaagcgtgtggtggctcccggcctggtggactgctttgtcaatgtgggagccaggtggtccctggactacatggacaacgtcaaccccttcaaccaccaccgcaatgcgggtctgcgctaccgctccatgatcctgggcaacgggcgctacgtgcccttccacattcaggtgccccagaagttctttgccatcaagaacctcctcctcctgccgggctcctacacttacgagtggaacttcaggaaggatgtcaacatggtcctgcagagctctctgggcaatgaccttagggtggacggggccagcatcaagtttgacagcgtcaccctctatgctaccttcttccccatggctcacaacaccgcctccacgctcgaggccatgctgaggaacgacaccaacgaccagtccttcaatgactacctctctggggccaacatgctctaccccatccccgccaaggccaccaacgtgcccatctccattccctctcgcaactgggccgccttcagaggctgggcctttacccgccttaagaccaaggaaaccccctccctgggctcgggttttgacccctactttgtctactcgggatccatcccctacctggatggcaccttctacctcaaccacacttttaagaagatatccatcatgtatgactcctccgtcagctggccgggcaatgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccattggcatcactcaccagcacaacaactcgggattcgtgggctacctggctcccaccatgcgcgaggggcaggcctaccccgccaacttcccctacccgttgataggcaaaaccgcggtcgacagcgtcacccagaaaaagttcctctgcgaccgcaccctctggcgcatccccttctctagcaacttcatgtccatgggtgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacctgctacctcttcgacccctttggcttctccgatcagcgcctcagacagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcacatccggggggccacctctttctgccacttgcaagaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttaaactcgggcaccaccatgcggggcagtggttcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattatgcacgctggccagcaggctctcgtcgctgatcatgtcgctgtccagatcctccgcgttgctcagggcgaacggggtcatcttgcagacctgcctgcccaggaaaggcggcagcccgggcttgccgttgcagtcgcagcgcaggggcatcagcaggtgcccgcggcccgactgcgcctgcgggtacagcgcgcgcatgaaggcttcgatctgcctgaaagccacctgcgtcttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtaccgtgcagacacttcaggtcgccctccgtctgggtgcagcggtgctcccacagcgcgcaaccggtgggctcccaatttttgtgggtcacccccgcgtaggcctgcaggtaggcctgcaagaagcgccccatcatggccacaaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagcgccgcctgctcttcttcgtcttcgctgtctaccactatctctggggaagggcttctccgctctgcggcggcgcgcttcttttttttcttgggagcggccgtgatggagtccgccacggcgacggaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcttctcgagctggtcttggtcccgactggccattgtatcctcctcctcctaggcagagagacataaggagtctatcatgcaagtcgagaaggaggagagcttaaccaccccctctgagaccgccgatgcgcccgccgtcgccgtcgcccccgctgccgccgacgcgcccgccacaccgagcgacacccccgcggacccccccgccgacgcacccctgttcgaggaagcggccgtggagcaggacccgggctttgtctcggcagaggaggatttgcgagaggaggaggataaggagaagaagccctcagtgccaaaagatgataaagagcaagacgagcacgacgcagatgcacaccagggtgaagtcgggcggggggacggagggcatgacggcgccgactacctagacgaagggaacgacgtgctcttgaagcacctgcatcgtcagtgcgccattgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgcctttgtggtacccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtaccaaagatcttcgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctaaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgtggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgcctggaggagcgcaacctcaaggagctggagaagctcctgcagcgcgcgctcaaagatctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaagaccaatcccgcccgcccaaggcggagctgaccgcctgcgtcatcacccagggcgagatcctaggccaattgcaagccatccaaaaagcccgccaagactttttgctgaagaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcaattaccaccacgccccgcaataatcccaaccccagggagtggcccgcgtccctggtgtatcaggaaattcccggccccaccaccgtactacttccgcgtgattcccaggccgaagtccaaatgactaactcaggggcacagctcgcgggcggctgtcgtcacagggtgcggcctcctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcaaagctcgtcctcggcgccgcgctcgggcggcatcgggactctccagttcgtgcaggagtttgtgccctcggtctacttcaaccccttctcgggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgaggaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacgagagttaacacttgtggggtttctggtgtatgtgacgctggtggtggctcttttgattaaggcttttccttccatgtctgaactctccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgactttatagagccccagtgtaatgtgacttttaaagcccatgcacagcgttgtcatactataatcaaatgtgccaccgaacacgatgaataccttatccagtataaagataaatcacacaaagtggcacttgttgacatctggaaacccgaagaccctttggaatacaatgtgaccgttttccagggtgacctcttcaaaatttacaattacactttcccatttgaccagatgtgtgactttgtcatgtacatggaaaagcagcacaagctgtggcctccgactccccagggctgtgtggaaaatccaggctctttctgcatgatctctctctgtgtaactgtgctggcactaatactcacgcttttgtatatcagatttaaatcaaggcaaagcttcattgatgaaaagaaaatgccttaatcgctttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaatagccacaagcccagagccatctgcgatgggcaaaatctaaccttgattgatgttcaattgctggatgcgggctactattatgggcagctgggtacaatgattaattactggagaccccacagagattacatgctccacgtagtaaagggtccccttagcagcccacccactaccacctctactacccccactaccaccactactcccaccaccagcactgccgcccagcctcctcatagcagaacaaccacttttatcaattccaagtcccactccccccacattgccggcgggccctccgcctcagactccgaaaccaccgagatctgcttctgcaaatgctctgacgccattgcccaggatttggaagatcacgaggaagatgagcatgacttcgcagatgcatgccaggcatcagagccagaagcgctgccggtggccctcaaacagtatgcagacccccacaccacccccgaccttcctccaccttcccagaagccaagtttcctgggggaaaatgaaactctgcctctctccatactcgctctgacatctgttgctatgttgaccgctctgctggtgcttctatgctctatatgctacctgatctgctgcagaaagaaaaaatctcacggccatgctcaccagcccctcatgcacttcccttaccctccagagctgggcgaccacaaactttaagtctgcagtaactatctgcccatcccttgtcagtcgacagcgatgagccccactaatctaacggcctctggacttacaacatcgtctcttaatgagaccaccgctcctcaagacctgtacgatggtgtctccgcgctggttaaccagtgggatcacctgggcatatggtggctcctcataggagcagtgaccctgtgcctaatcctggtctggatcatctgctgcatcaaaagcagaagacccaggcggcggcccatctacaggccctttgtcatcacacctgaagatgatgatgacaccacttccaggctgcagaggctaaagcagctactcttctcttttacagcatggtaaattgaatcatgcctcgcattttcatctacttgtctctccttccactttttctgggctcttctacattggccgctgtgtcccacatcgaggtagactgcctcacgcccttcacagtctacctgcttttcggctttgtcatctgcacctttgtctgcagcgttatcactgtagtgatctgcttcatacagtgcatcgactacgtctgcgtgcgggtggcttactttagacaccacccccagtatcgcaacagggacatagcggctctcctaagacttgtttaaaatcatggccaaattaactgtgattggtcttctgatcatctgctgcgtcctagccgcgattgggactcaagctcctaccaccaccagcgctcccagaaagagacatgtatcctgcagcttcaagcgtccctggaatataccccaatgctttactgatgaacctgaaatctctttggcttggtacttcagcgtcaccgcccttcttatcttctgcagtacggttattgcccttgccatctacccttcccttgacctgggctggaatgctgtcaactctatggaatatcccaccttcccagaaccagacctgccagacctggttgttctaaacgcgtttcctcctcctgctcccgttcaaaatcagtttcgccctccgtcccccacgcccactgaggtcagctactttaatctaacaggcggagatgactgaaaacctagacctagaaatggacggtctctgcagcgagcaacgcacactagagaggcgccggcaaaaagagctcgagcgtcttaaacaagagctccaagacgcggtggccatacaccagtgcaaaaaaggtgtcttctgtctggtaaaacaggccacgctcacctatgaaaaaacaggtgacacccaccgcctaggatacaagctgcccacacagcgccaaaagttcgccctcatgataggcgaacaacccatcaccgtgacccagcactccgtggagacagaaggctgcatacatgctccctgtaggggcgctgactgcctctacaccttgatcaaaaccctctgcggtctcagagaccttatccctttcaattaatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtccctttccttacccctccctttgtgtcatccgcaggaatgcaagaaaatccagctggggtgctgtccctgcacttgtcagagccccttaccacccacaatggggccctgactctaaaaatggggggcggcctgaccctggacaaggaagggaatctcacttcccaaaacatcaccagtgtcgatccccctctcaaaaaaagcaagaacaacatcagccttcagaccgccgcacccctcgccgtcagctccggggccctaacactttttgccactccccccctagcggtcagtggtgacaaccttactgtgcagtctcaggcccctctcactttggaagactcaaaactaactctggccaccaaaggacccctaactgtgtccgaaggcaaacttgtcctagaaacagaggctcccctgcatgcaagtgacagcagcagcctgggccttagcgttacggccccacttagcattaacaatgacagcctaggactagatctgcaggcacccattgtctctcaaaatggaaaactggctctaaatgtagcaggccccctagctgtggccaatggcattaatgctttgacagtaggcacaggcaaaggtattggtctaaatgaaaccagcactcacttgcaagcaaagttggtcgcccccctaggctttgataccaatggcaacattaagctaagcgttgcaggaggcatgagactaaataatgacacacttatactagatgtaaactacccatttgaagctcaaggccaactaagtctaagagtgggccagggtccgctgtatgtagattctagcagccataacctgaccattagatgccttagaggattatacataacatcgtctaataaccaaaccggtctagaggccaacataaaactaacaaaaggccttgtctatgatggaaatgccatagcagtcaatgttggtcaaggattgcaatacagcactactgccacatcggaaggtgtgtatcctatacagtctaagataggtttgggaatggaatatgataccaacggagccatgatgacaaaactaggctctggactaagctttgacaattcaggagccattgtagtgggaaacaaaaatgatgacaggcttactctgtggactacaccagacccatctcctaactgtagaatttattctgaaaaagatactaaactaaccttggtgctgactaagtgtggcagccaaatcctaggcacagtatctgcccttgctgtcagaggcagccttgcgcccatcactaatgcatccagcatagtccaaatatttctaagatttgatgaaaatggactattgatgagcaactcatcgctagacggtgattactggaattacagaaatggggactccactaatagcacaccatatacaaatgcagtaggctttatgcctaatctagcagcctatcctaaaggtcaggctacagctgcaaaaagcagtattgtaagccaggtatacatggatggtgacactactaaacctataacactaaaaataaacttcaatggcattgatgaaacaacagaaaatacccctgttagtaaatattccatgacattctcatggagctggcccaccgcaagctacataggccacacttttgcaacaaactcttttactttctcctacatcgcccaagaataaagaaagcacagagatgcttgttttgatttcaaaattgtgtgcttttatttattttcagcttacagtatttccagtagtcattcgaataaagcttaatcaaactgcatgagaacccttccacatagcttaaattagcaccagtgcaaatggagaaaattcaacataccttttttatccagatatcagagaactctagtggtcagttttcccccaccctcccagctcacagaatacacagtcctttccccccggctggctttaaacaacactatctcattggtaacagacatattcttaggtgtaataatccacacggtctcttggcgggccaagcgctggtcggtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgcagcaacaaggcgcgcagcaactcctgccgccgcctctccgtacgacaggaatgcaacggcgtggtggtctcctccgcgataatccgcaccgctcgcagcatcagcatcctcgtcctccgggcacagcagcgcatcctgatctcactgagatcggcgcagtaagtgcagcacaaaaccaagatgttatttaagatcccacagtgcaaagcactgtacccaaagctcatggcgggaaggacagcccccacgtgaccatcataccagatccttaggtaaatcaaatgacgacctctcataaacacgctggacatgtacatcacctccttgggcatgcgctgattcaccacctctcgataccacaagcatcgctgattaattaaagacccctcaagcaccatcctgaaccaggaagccagcacctgaccccccgccaggcactgcagggaccccggtgaattgcagtggcagtgaagactccagcgctcgtagccgtgaaccatagagccggtcattatatccacattggcacaacacaaacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagctcgcgtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgctcggtgtagtagttgtaatacagccactccctcagaccgtcaaggcgctccctggcgtccggatctataacaacaccgtcctgcagcgccgccctgatgacatccaccaccgtagagtatgccaagcccagccaggaaatgcattcactttgacagcgagagataggaggagcgggaagagatggaagaaccatgatagtaaaagacttttattccaatcgatcctctacaatgtcaaagtgtagatctataagatgacactggtctcctccgctgagtcgatcaaaaataacagctaaaccacaaacaacacgattggtcaaatgctccacaagggcttgcagcataaaatcgcctcgaaagtccaccgcaagcataacatcaaagccaccgcccctatcatgatctataataaaaaccccacagctatccaccagacccataaagttttcatctctccatcgtgaaaaaatatttacaagctcctcctttaaatcacctccaaccaattgaaaaagttgagccaaaccgccctccaccttcattttcagcaagcgcatcatgattgcaaaaattcaggctcctgagacacctgtataagattgagaagcggaacgttaacgtcaatgtttcgctcgcgaagatcgcgcctcagtgcaagcatgatataatcccacaggtcggagcggatcagcgaggacatctccccgccaggaaccaactcaacggagcctatgctgattataatacgcatattcggggctatgctgaccagcacggcccccaaataggcgtactgcataggcggcgacaaaaagtgaacagtttgggttaaaaaatcaggcaaacagtcgcgcaaaaaagcaagaacatcataaccatgctcatgcaaatagatgcaagtaagctcaggaacgaccacagaaaaatgcacaatttttctctcaaacatgactgcgagccctgcaaaaaataaaaaagaaacattacacaagagtagcctgtcttacgatgggatagactactctaaccaacataagacgggccacaacatcgcccgcgtggccataaaaaaaattgtccgtgtgattaaaaagaagcacagatagctggccagtcatatccggagtcatcacgtgtgaacccgtgtagacccccgggttggacacatcggccaaacaaagaaagcggccaatgtacccaggaggaatcataacactaagacgaagatacaacagaataaccccatgagggggaataacaaagttagtaggtgaataaaaacgataaacacccgaaactccctcctgcgtaggcaaaatagcaccctccccttccaaaacaacatatagcgcttccacagcagccatgacaaaagactcaaaacactcaaaagactcagtcttaccaggaaaataaaagcactctcacagcaccagcactaatcagagtgtgaagagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccggtttctcacggtacgtcacttccgcaagaaaagcaaaactacatttcccacatgtgtaaaaacgaaaccccgccccttgtaactgcccacaacttacatcatcaaaacataaactcctacgtcacccgccccgcctctccccgcccacctcattatcatattggccacaatccaaaataaggtatattattgatgatg

SEQ ID NO: 11 - DNA, 37213 bp, Gorilla beringei beringei
ataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcaccgtcatttgacgcggagggtatttaaacccgctgcgctcctcaagaggccactcttgagtgccagcgagaagagttttctcctctgctccgcttcggtgatcgaaaaatgagacacatagcctgcactccgggtcttttgtccggtcgggcggcggccgagcttttggacgctttgatcaatgatgtcctaagcgatgattttccgtctactacccactttagcccacctactcttcacgaactgtacgatctggatgtactggtggatgtgaacgatcccaacgaggaggcggtttctgcgttttttcccgagtctgcgctgttggccgctcaggagggatttgacctacacactccgccgcctattttagagtctccgctgccggagcccagtggtataccttatatgcctgaactgcttcccgaagtggtagacctgacctgccacgagcctggctttccgcccagcgacgatgagggtgagccttttgttttagactttgctgagatacctgggcacggttgcaggtcttgtgcatatcatcagagggttaccggagaccccgaggttaagtgttcgctgtgctatatgaggatgacctcttcctttatctacagtaagtttttgtctaggtgggcttttgggtaggtgggttttgtgtcagaacaggtgtaaacgttgcttgtgttttttgtacctgtaggtccggtgtccgagccagacccggagcccgaccgcgatcccgagccggatcccgagcctcctcgcaggacaaggaaactaccttccattctgtgcaagtctcagacacctgtaaggaccagcgaggcagacagcaccgactctggcacttctacctctccccctgaaattcacccagtggttcctctgggtatacataaacctgttgctgttaaagtttgcgggcgacgccctgcagtacagtgcattgaggacttgcttcacgatcccgaggaacctttggacttgagccttaaacgccctaggcaataaaccccacctaagtaataaaccccacctaagtaataaaccctgccgcccttggttattgagatgacgcccaatgtttgcttttgaatgacttcatgtgtgtaataaaagtgagtgtgatcataggtctcttgtttgtctgggcggggcttaagggtatataagtctcttggggctaaacttggttacacttgaccccaatggaggcgtgggggtgcttggaggagtttgcggacgtgcgccgtttgctggacgagagctctagcaatacctatactatttggaggtatctgtggggctctactcaggccaagttggtttccagaattaagcaggattacaagtgcgattttgaagagctttttagttcctgcggtgagcttttgcaatccttgaatctgggccatcaggctattttccaggaaaaggttctctcgactttggatttttccactcccgggcgcaccgccgcttgtgtggcttttgtgtcttttgtgcaagataaatggagcgaggagacccacctgagtcacggctacgtactggatttcatggcgatggctctttggagggctcacaacaaatggaagattcagaaggaactgtacggttccgccctacgtcgtccacttctgtcgcgacaggggctgaggtttcccgaccatcggcagcatcagaatctggaagacgagtcggaggagcgagcggaggagaagatcagcttgagagccggcctggaccctcctcaggaggaatgaatctcccgcaggtggttgacctgtttccagaactgagacgggtcctgactatcagggaggatggtcagtttgtgaagaagtttaagagggatcggggtgagggagatgatgaggcggctagcaatttagcttttagtctgatgactcgccaccgaccggaatgtattacctatcagcagattaaggagagttgtgccaacgagctggatcttttgggtcagaagtatagcatagaacagcttaccacttactggcttcagcctggggatgattgggaagaggcgatcagggtgtatgcaaaggtggccctgcggcccgattgcaagtataagattactaagttggttaatattagaaactgctgctatatttctgggaacggggccgaagtggagatagatactcaggacagggtggcttttaggtgttgcatgataaacatgtggcccgggatactggggatggatggggtggtattcatgaatgtgaggtttacgggccccaactttaatggcacggtgttcatgggcaacaccaacttgctcctgcatggtgcgagtttctatgggtttaataacacctgtatagaggcctggaccgatgtaaaggttcgaggttgttccttttatagctgttggaaggcggtggtgtgtcgccctaaaagcaggggttctgtgaaaaaatgcttgtttgaaaggtgcaccttaggcatcctctctgagggcaactccagggtgcgccataatgtggcttcgaactgcggttgcttcatgcaagtgaagggggtgagcgttatcaagcataactcggtgtgtggaaactgcgaggatcgcgcctcccagatgctgacctgctttgatggcaactgtcacctgttgaagaccattcatataagcagccaccccagaaaggcctggcccgtgtttgagcataacatcttgacccgctgctccttgcatctgggggtcaggaggggtatgttcctgccttaccagtgtaactttagccacactaaaatcctgctggaacccgagtgcatgaccaaggtcagcctgaatggtgtgtttgatgtgactctgaaaatctggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgcaccagggccgagtttgggtctagcgatgaggataccgattgaggtgggtaaggtgggcgtggctagaagggtggggcgtgtataaattgggggtctaagggtctctctgttttgtcttgcaacagccgccgccatgagcgacaccggcaacagctttgatggaagcatctttagcccctatctgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcggcgcggcctctcgcgcgtctgctcgggatgagaaactgaccgctctgctgcttaaactggaagacttgacccgggagctgggtcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataggacatctttacgaatcgggggcggagggtcccggactgggggatgatggtaccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagcctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcgccctttcatcttcactctcttccgcatcgctgtctgcgagggccagctgctggggtaagtattccctctcgaaggcgggcatgacctcagcgctcaggttgtcagtttctaaaaatgaggaggatttgatgttcacctgtccggaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggattaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaaggaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacaggcatgggcggcaggggcacgtcttcgccgcgcgcgggcaggggctggtgctggctccgaagagcgcttgcgtgcgcgacgacgcgacggttggtgtcctgtatctgacgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcttcctggagatctcctcgtccggcgcgctccacggtggccgccaggtcgttggagatgcgacccatgagctgtgagaaggcgttgagcccgccctcgttccagacccggctgtagaccacgcccccctcggcgtcgcgagcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgttgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgagcggccgtgaggtagcgagacggcgctgactatgcatcttaacaattgctgtgtaggtacaccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcatgaggcggtggtatccgtagatgtacctggacatccaggtgatgccggcggcggtggtggtggcgcgcgcgtagtcgcggacccggttccagatgtttcgcaggggcgagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttgaatcggccggaaccgcggctaacgagggccgtggcagccccgtcctcaggaccccgccagccgacttctccagttacgggagcgagccccttttgttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtaaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggccgatgaccaggaagaggaggactatgagctagaggagggcgagtacctggaggactgacctggctggtggtgttttggtatagatgcaagatccgaacgtggcggacccggcggtccgggcggcgctgcaaagccagccgtccggcattaactcctctgacgactgggccgcggccatgggtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggacgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttcaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggagacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacccaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgtttatcaaccgcctgatggactacttgcatcgggcggcggccgtgaaccccgagtacttcactaatgccattctgaatccccactggatgccccctccgggtttctacaacggggactttgaggtgcccgaggtcaacgacgggttcctctgggatgacatggatgacagtgtgttctcacccaacccgctgcgcgccgcgtctctgcgattgaaggagggctctgacagggaaggaccgaggagtctggcctcctccctggctctgggagcggtgggcgccacgggcgcggcggcgcggggcagtagccccttccccagcctggcagactctctgaacagcgggcgggtgagcaggccccgcttgctaggcgaggaggagtatctgaacaactccctgctgcagcccgcgagggacaagaacgctcagcggcagcagtttcccaacaatgggatagagagcctggtggacaagatgtccagatggaagacgtatgcgcaggagtacaaggagtgggaggaccgccagccgcggcccttgccgccccctaggcagcgctggcagcggcgcgcgtccaaccgccgctggaggcaggggcccgaggacgatgatgactctgcagatgacagcagcgtgttggacctgggcgggagcgggaaccccttttcgcacctgcgcccacgcctgggcaagatgttttaaaagaaaaaaaaaataaaactcaccaaggccatggcgacgagcgttggttttttgttcccttccttagtatgcggcgcgcggcgatgttcgaggaggggcctcccccctcttacgagagcgcgatggggatttctcctgcggcgcccctgcagcctccctacgtgcctcctcggtacctgcaacctacaggggggagaaatagcatctgttactctgagctgcagcccctgtacgataccaccagactgtacctggtggacaacaagtccgcggacgtggcctccctgaactaccagaacgaccacagcgattttttgaccacggtgatccaaaacaacgacttcaccccaaccgaggccagcacccagaccataaacctggataacaggtcgaactggggcggcgacctgaagaccatcttgcacaccaacatgcccaacgtgaacgagttcatgttcaccaactcttttaaggcgcgggtgatggtggcgcgcgagcagggggaggcgaagtacgagtgggtggacttcacgctgcccgagggcaactactcagagaccatgactctcgacctgatgaacaatgcgatcgtggaacactatctgaaagtgggcaggcagaacggggtgaaggaaagcgatatcggggtcaagtttgacaccagaaacttccgtctgggctgggaccccgtgaccgggctggtcatgccgggggtctacaccaacgaggcctttcatcccgacatagtgcttctgcccggctgtggggtggacttcacccagagccggctgagcaacctgctgggcattcgcaagcggcagcctttccaggagggtttcaagatcacctatgaggatctgaaggggggcaacattcccgcgctccttgatctggacgcctacgaggagagcttgaaacccgaggagagcgctggcgacagcggcgagagtggcgaggagcaagccggcggcggtggcggcgcgtcggtagaaaacgaaagtacgcccgcagtggcggcggacgctgcggaggtcgagccggaggccatgcagcaggacgcagaggagggcgcacaggagggcgcgcagaaggacatgaacgatggggagatcaggggagacacattcgccacccggggcgaagaaaaagaggcagaggcggcggcggcggcgacggcggaggccgaaaccgaggttgaggcagaggcagagcccgagaccgaagttatggaagacatgaatgatggagaacgtaggggcgacacgttcgccacccggggcgaagagaaggcggcggaggcagaagccgcggctgaggaggcggctgcggctgcggccaagactgaggctgcggctaaggctgaggtcgaagccaatgttgcggttgaggctcaggctgaggaggaggcggcggctgaagcagttaaggaaaaggcccaggcagagcaggaagagaaaaaacctgtcattcaacctctaaaagaagatagcaaaaagcgcagttacaacgtcatcgagggcagcacctttacccagtaccgcagctggtacctggcgtacaactacggcgacccggtcaagggggtgcgctcgtggaccctgctctgcacgccggacgtcacctgcggctccgagcagatgtactggtcgctgccgaacatgatgcaagacccggtgaccttccgctccacgcggcaggttagcaacttcccggtggtgggcgccgaactgctgcccgtgcactccaagagtttttacaacgagcaggccgtctactcccagctgatccgccaggccacctctctgacccacgtgttcaatcgctttcccgagaaccagattttggcgcgcccgccggcccccaccatcaccaccgtgagtgaaaacgttcctgccctcacagatcacgggacgctaccgctgcgcaacagcatctcaggagtccagcgagtgaccattactgacgccagacgccggacctgcccctacgtttacaaggccttgggcatagtctcgccgcgcgtcctctccagtcgcactttttaaaacacatctacccacacgttccaaaatcatgtccgtactcatctcacccagcaacaacaccggctgggggctgcgcgcgcccagcaagatgtttggaggggcgaggaagcgctccgaccagcaccctgtgcgcgtgcgcggccactaccgcgcgccctggggagcgcacaagcgcgggcgcacagggcgcaccactgtggacgacgtcattgactccgtagtggagcaagcgcgccactacacacccggcgcgccgaccgcccccgccgtgtccaccgtggaccaggcgatcgaaagcgtggtacagggcgcgcggcactatgccaaccttaaaagtcgccgccgccgcgtggcccgccgccatcgccggagaccccgggccaccgccgccgcgcgccttactaaggctctgctcaggcgcgccaggcgaactggccaccgggccgccatgagggccgcacggcgggctgccgctgccgcaagcgtcgtggccccgcgggcacgaaggcgcgcggccgctgccgccgccgccgccatttccagcttggcctcgacgcggcgcggtaacatatactgggtgcgcgactcggtaaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgacgaggcggtggagtttgtccgccgcatggcacccaggcgccccgtgcagtggaagggccggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtaaccctgcaacaggtgctgcctttgagcgcgcccagcgagcataagcgagggttgaagcgcgaaggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcggcggccagcgccaccaccggcaccgcttcggtagaggtgcagacggacccctggctacccgccaccgctgttgccgccgccgccccccgttcgcgcgggcgcaagagaaattatccagcggccagcgcgctcatgccccagtacgcactgcatccatccatcgtgcccacccccggctaccgcgggtactcgtaccgcccgcgcagatcagccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcattttttggaggaaaaataaaaaaaagtctagactctcacgctcgcttggtcctgtgactattttgtagaaaaaaagatggaagacatcaactttgcgtcgctggccccgcgtcacggctcgcgcccgttcatgggagactggacagatatcggcaccagcaatatgagcggtggcgccttcagctggggcagtctgtggagcggccttaaaaattttggttccaccattaagaactatggcaacaaagcgtggaacagcagcacgggccagatgctgagagacaagttgaaagagcagaacttccaggagaaggtggcgcagggcctggcctctggcatcagcggggtggtggacatagctaaccaggccgtgcagaaaaagataaacagtcatctggacccccgtcctcaggtggaggaaatgcctccagcgatggagacggtgtctcccgagggcaaaggcgaaaagcgcccgcggcccgacagagaagagaccctggtgtcacacaccgaggagccgccctcttacgaggaggcagtcaaggccggcctgcccaccactcgccccatagcccccatggccaccggtgtggtgggccacaggcaacacactcccgcaacactagatctgcccccgccgtccgagccgccgcgccagccaaaggcggcgacggtgcccgctccctccacttccgccgccaacagagtgcccctgcgccgcgccgcgagcggcccccgggcctcgcgagttagcggcaactggcagagcacactgaacagcatcgtgggcctgggagtgaggagtgtgaagcgccgccgttgctactgaatgagcaagctagctaacgtgttgtatgtgtgtatgcgtcctatgtcgccgccagaggagctgttgagccgccggcgccgtctgcactccagcgaatttcaagatggcgaccccatcgatgatgcctcagtggtcgtacatgcacatctcgggccaggacgcttcggagtacctgagccccgggctggtgcagttcgcccgcgccacagacacctacttcaacatgagtaacaagttcaggaaccccactgtggcgcccacccacgatgtgaccacggaccggtcgcagcgcctgacgctgcggttcatccccgtggatcgggaggacaccgcctactcttacaaggcgcggttcacgctggccgtgggcgacaaccgcgtgctggacatggcctccacttactttgacatcaggggggtgctggacaggggccccaccttcaagccctactcgggtactgcctacaactccctggcccccaagggcgctcccaattcttgcgagtgggaacaagatgaaccagctcaggcagcaatagctgaagatgaagaagaacttgaagaagaacaagctcaggacgaacaggcgcccactaagaaaacccatgtatacgcccaggcacctctttctggtgaaaaaattactaaggatggtttgcaaataggtgtggatgccacacaggcgggagataaccctatatatgctgataaaacattccaacccgaacctcagataggtgagtctcagtggaacgaggctgatgccacagtagcaggaggcagagtcttaaaaaagaccacccctatgagaccttgctatggatcctatgccaaacctactaatgccaatggcggtcaagggatcatggtggccaatgatcagggagcgcttgaatctaaagttgagatgcaatttttctccaccacaacgtctcttaatgtaagggaaggtgaaaacaatcttcagccaaaagtagtgctatacagcgaagatgttaacttggaatcccctgacactcatttgtcttacaaacctaaaaaggatgacaccaactctaaaatcatgttgggtcagcaagccatgcccaacagacccaacctcattgcttttagggacaactttattggacttatgtactacaacagcacaggcaacatgggagtgctggcaggacaggcctcccagctaaacgctgtggtagacttgcaagacagaaacacagagctgtcataccaactgatgcttgattccattggagacagatcaagatacttttccatgtggaaccaggcagtggacagctatgacccagatgtcagaatcattgaaaaccatggggttgaagatgagctgcccaactattgctttcccctgggcggtattggaattacagacacataccagtgcataaaaccaaccgcagctgctaataacactacatggtctaaggatgaagaatttagtgatcgcaatgaaataggggtgggaaacaacttcgccatggagatcaacatccaggccaacctctggaggaacttcctctatgcgaacgtggggctctacctgccagacaagctcaagtacaaccccaccaacgtggacatctctgacaaccccaacacctatgactacatgaacaagcgtgtggtggctcccggcctggtggactgctttgtcaatgtgggagccaggtggtccctggactacatggacaacgtcaaccccttcaaccaccaccgcaatgcgggtctgcgctaccgctccatgatcctgggcaacgggcgctacgtgcccttccacattcaggtgccccagaagttctttgccatcaagaacctcctcctcctgccgggctcctacacttacgagtggaacttcaggaaggatgtcaacatggtcctgcagagctctctgggcaatgaccttagggtggacggggccagcatcaagtttgacagcgtcaccctctatgctaccttcttccccatggctcacaacaccgcctccacgctcgaggccatgctgaggaacgacaccaacgaccagtccttcaatgactacctctctggggccaacatgctctaccccatccccgccaaggccaccaacgtgcccatctccattccctctcgcaactgggccgccttcagaggctgggcctttacccgccttaagaccaaggaaaccccctccctgggctcgggttttgacccctactttgtctactcgggatccatcccctacctggatggcaccttctacctcaaccacacttttaagaagatatccatcatgtatgactcctccgtcagctggccgggcaatgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccattggcatcactcaccagcacaacaactcgggattcgtgggctacctggctcccaccatgcgcgaggggcaggcctaccccgccaacttcccctacccgttgataggcaaaaccgcggtcgacagcgtcacccagaaaaagttcctctgcgaccgcaccctctggcgcatccccttctctagcaacttcatgtccatgggtgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacctgctacctcttcgacccctttggcttctccgatcagcgcctcagacagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcacatccggggggccacctctttctgccacttgcaagaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttaaactcgggcaccaccatgcggggcagtggttcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattatgcacgctggccagcaggctctcgtcgctgatcatgtcgctgtccagatcctccgcgttgctcagggcgaacggggtcatcttgcagacctgcctgcccaggaaaggcggcagcccgggcttgccgttgcagtcgcagcgcaggggcatcagcaggtgcccgcggcccgactgcgcctgcgggtacagcgcgcgcatgaaggcttcgatctgcctgaaagccacctgcgtcttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtaccgtgcagacacttcaggtcgccctccgtctgggtgcagcggtgctcccacagcgcgcaaccggtgggctcccaatttttgtgggtcacccccgcgtaggcctgcaggtaggcctgcaagaagcgccccatcatggccacaaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagcgccgcctgctcttcttcgtcttcgctgtctaccactatctctggggaagggcttctccgctctgcggcggcgcgcttcttttttttcttgggagcggccgtgatggagtccgccacggcgacggaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcttctcgagctggtcttggtcccgactggccattgtatcctcctcctcctaggcagagagacataaggagtctatcatgcaagtcgagaaggaggagagcttaaccaccccctctgagaccgccgatgcgcccgccgtcgccgtcgcccccgctgccgccgacgcgcccgccacaccgagcgacacccccgcggacccccccgccgacgcacccctgttcgaggaagcggccgtggagcaggacccgggctttgtctcggcagaggaggatttgcgagaggaggaggataaggagaagaagccctcagtgccaaaagatgataaagagcaagacgagcacgacgcagatgcacaccagggtgaagtcgggcggggggacggagggcatgacggcgccgactacctagacgaagggaacgacgtgctcttgaagcacctgcatcgtcagtgcgccattgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgcctttgtggtacccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtaccaaagatcttcgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctaaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgtggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgcctggaggagcgcaacctcaaggagctggagaagctcctgcagcgcgcgctcaaagatctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaagaccaatcccgcccgcccaaggcggagctgaccgcctgcgtcatcacccagggcgagatcctaggccaattgcaagccatccaaaaagcccgccaagactttttgctgaagaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcaattaccaccacgccccgcaataatcccaaccccagggagtggcccgcgtccctggtgtatcaggaaattcccggccccaccaccgtactacttccgcgtgattcccaggccgaagtccaaatgactaactcaggggcacagctcgcgggcggctgtcgtcacagggtgcggcctcctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcaaagctcgtcctcggcgccgcgctcgggcggcatcgggactctccagttcgtgcaggagtttgtgccctcggtctacttcaaccccttctcgggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgaggaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacgagagttaacacttgtggggtttctggtgtatgtgacgctggtggtggctcttttgattaaggcttttccttccatgtctgaactctccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgactttatagagccccagtgtaatgtgacttttaaagcccatgcacagcgttgtcatactataatcaaatgtgccaccgaacacgatgaataccttatccagtataaagataaatcacacaaagtggcacttgttgacatctggaaacccgaagaccctttggaatacaatgtgaccgttttccagggtgacctcttcaaaatttacaattacactttcccatttgaccagatgtgtgactttgtcatgtacatggaaaagcagcacaagctgtggcctccgactccccagggctgtgtggaaaatccaggctctttctgcatgatctctctctgtgtaactgtgctggcactaatactcacgcttttgtatatcagatttaaatcaaggcaaagcttcattgatgaaaagaaaatgccttaatcgctttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaatagccacaagcccagagccatctgcgatgggcaaaatctaaccttgattgatgttcaattgctggatgcgggctactattatgggcagctgggtacaatgattaattactggagaccccacagagattacatgctccacgtagtaaagggtccccttagcagcccacccactaccacctctactacccccactaccaccactactcccaccaccagcactgccgcccagcctcctcatagcagaacaaccacttttatcaattccaagtcccactccccccacattgccggcgggccctccgcctcagactccgaaaccaccgagatctgcttctgcaaatgctctgacgccattgcccaggatttggaagatcacgaggaagatgagcatgacttcgcagatgcatgccaggcatcagagccagaagcgctgccggtggccctcaaacagtatgcagacccccacaccacccccgaccttcctccaccttcccagaagccaagtttcctgggggaaaatgaaactctgcctctctccatactcgctctgacatctgttgctatgttgaccgctctgctggtgcttctatgctctatatgctacctgatctgctgcagaaagaaaaaatctcacggccatgctcaccagcccctcatgcacttcccttaccctccagagctgggcgaccacaaactttaagtctgcagtaactatctgcccatcccttgtcagtcgacagcgatgagccccactaatctaacggcctctggacttacaacatcgtctcttaatgagaccaccgctcctcaagacctgtacgatggtgtctccgcgctggttaaccagtgggatcacctgggcatatggtggctcctcataggagcagtgaccctgtgcctaatcctggtctggatcatctgctgcatcaaaagcagaagacccaggcggcggcccatctacaggccctttgtcatcacacctgaagatgatgatgacaccacttccaggctgcagaggctaaagcagctactcttctcttttacagcatggtaaattgaatcatgcctcgcattttcatctacttgtctctccttccactttttctgggctcttctacattggccgctgtgtcccacatcgaggtagactgcctcacgcccttcacagtctacctgcttttcggctttgtcatctgcacctttgtctgcagcgttatcactgtagtgatctgcttcatacagtgcatcgactacgtctgcgtgcgggtggcttactttagacaccacccccagtatcgcaacagggacatagcggctctcctaagacttgtttaaaatcatggccaaattaactgtgattggtcttctgatcatctgctgcgtcctagccgcgattgggactcaagctcctaccaccaccagcgctcccagaaagagacatgtatcctgcagcttcaagcgtccctggaatataccccaatgctttactgatgaacctgaaatctctttggcttggtacttcagcgtcaccgcccttcttatcttctgcagtacggttattgcccttgccatctacccttcccttgacctgggctggaatgctgtcaactctatggaatatcccaccttcccagaaccagacctgccagacctggttgttctaaacgcgtttcctcctcctgctcccgttcaaaatcagtttcgccctccgtcccccacgcccactgaggtcagctactttaatctaacaggcggagatgactgaaaacctagacctagaaatggacggtctctgcagcgagcaacgcacactagagaggcgccggcaaaaagagctcgagcgtcttaaacaagagctccaagacgcggtggccatacaccagtgcaaaaaaggtgtcttctgtctggtaaaacaggccacgctcacctatgaaaaaacaggtgacacccaccgcctaggatacaagctgcccacacagcgccaaaagttcgccctcatgataggcgaacaacccatcaccgtgacccagcactccgtggagacagaaggctgcatacatgctccctgtaggggcgctgactgcctctacaccttgatcaaaaccctctgcggtctcagagaccttatccctttcaattaatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtccctttccttacccctccctttgtgtcatccgcaggaatgcaagaaaatccagctggggtgctgtccctgcacttgtcagagccccttaccacccacaatggggccctgactctaaaaatggggggcggcctgaccctggacaaggaagggaatctcacttcccaaaacatcaccagtgtcgatccccctctcaaaaaaagcaagaacaacatcagccttcagaccgccgcacccctcgccgtcagctccggggccctaacactttttgccactccccccctagcggtcagtggtgacaaccttactgtgcagtctcaggcccctctcactttggaagactcaaaactaactctggccaccaaaggacccctaactgtgtccgaaggcaaacttgtcctagaaacagaggctcccctgcatgcaagtgacagcagcagcctgggccttagcgttacggccccacttagcattaacaatgacagcctaggactagatctgcaggcacccattgtctctcaaaatggaaaactggctctaaatgtagcaggccccctagctgtggccaatggcattaatgctttgacagtaggcacaggcaaaggtattggtctaaatgaaaccagcactcacttgcaagcaaagttggtcgcccccctaggctttgataccaatggcaacattaagctaagcgttgcaggaggcatgagactaaataatgacacacttatactagatgtaaactacccatttgaagctcaaggccaactaagtctaagagtgggccagggtccgctgtatgtagattctagcagccataacctgaccattagatgccttagaggattatacataacatcgtctaataaccaaaccggtctagaggccaacataaaactaacaaaaggccttgtctatgatggaaatgccatagcagtcaatgttggtcaaggattgcaatacagcactactgccacatcggaaggtgtgtatcctatacagtctaagataggtttgggaatggaatatgataccaacggagccatgatgacaaaactaggctctggactaagctttgacaattcaggagccattgtagtgggaaacaaaaatgatgacaggcttactctgtggactacaccagacccatctcctaactgtagaatttattctgaaaaagatactaaactaaccttggtgctgactaagtgtggcagccaaatcctaggcacagtatctgcccttgctgtcagaggcagccttgcgcccatcactaatgcatccagcatagtccaaatatttctaagatttgatgaaaatggactattgatgagcaactcatcgctagacggtgattactggaattacagaaatggggactccactaatagcacaccatatacaaatgcagtaggctttatgcctaatctagcagcctatcctaaaggtcaggctacagctgcaaaaagcagtattgtaagccaggtatacatggatggtgacactactaaacctataacactaaaaataaacttcaatggcattgatgaaacaacagaaaatacccctgttagtaaatattccatgacattctcatggagctggcccaccgcaagctacataggccacacttttgcaacaaactcttttactttctcctacatcgcccaagaataaagaaagcacagagatgcttgttttgatttcaaaattgtgtgcttttatttattttcagcttacagtatttccagtagtcattcgaataaagcttaatcaaactgcatgagaacccttccacatagcttaaattagcaccagtgcaaatggagaaaattcaacataccttttttatccagatatcagagaactctagtggtcagttttcccccaccctcccagctcacagaatacacagtcctttccccccggctggctttaaacaacactatctcattggtaacagacatattcttaggtgtaataatccacacggtctcttggcgggccaagcgctggtcggtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgcagcaacaaggcgcgcagcaactcctgccgccgcctctccgtacgacaggaatgcaacggcgtggtggtctcctccgcgataatccgcaccgctcgcagcatcagcatcctcgtcctccgggcacagcagcgcatcctgatctcactgagatcggcgcagtaagtgcagcacaaaaccaagatgttatttaagatcccacagtgcaaagcactgtacccaaagctcatggcgggaaggacagcccccacgtgaccatcataccagatccttaggtaaatcaaatgacgacctctcataaacacgctggacatgtacatcacctccttgggcatgcgctgattcaccacctctcgataccacaagcatcgctgattaattaaagacccctcaagcaccatcctgaaccaggaagccagcacctgaccccccgccaggcactgcagggaccccggtgaattgcagtggcagtgaagactccagcgctcgtagccgtgaaccatagagccggtcattatatccacattggcacaacacaaacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagctcgcgtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgctcggtgtagtagttgtaatacagccactccctcagaccgtcaaggcgctccctggcgtccggatctataacaacaccgtcctgcagcgccgccctgatgacatccaccaccgtagagtatgccaagcccagccaggaaatgcattcactttgacagcgagagataggaggagcgggaagagatggaagaaccatgatagtaaaagacttttattccaatcgatcctctacaatgtcaaagtgtagatctataagatgacactggtctcctccgctgagtcgatcaaaaataacagctaaaccacaaacaacacgattggtcaaatgctccacaagggcttgcagcataaaatcgcctcgaaagtccaccgcaagcataacatcaaagccaccgcccctatcatgatctataataaaaaccccacagctatccaccagacccataaagttttcatctctccatcgtgaaaaaatatttacaagctcctcctttaaatcacctccaaccaattgaaaaagttgagccaaaccgccctccaccttcattttcagcaagcgcatcatgattgcaaaaattcaggctcctgagacacctgtataagattgagaagcggaacgttaacgtcaatgtttcgctcgcgaagatcgcgcctcagtgcaagcatgatataatcccacaggtcggagcggatcagcgaggacatctccccgccaggaaccaactcaacggagcctatgctgattataatacgcatattcggggctatgctgaccagcacggcccccaaataggcgtactgcataggcggcgacaaaaagtgaacagtttgggttaaaaaatcaggcaaacagtcgcgcaaaaaagcaagaacatcataaccatgctcatgcaaatagatgcaagtaagctcaggaacgaccacagaaaaatgcacaatttttctctcaaacatgactgcgagccctgcaaaaaataaaaaagaaacattacacaagagtagcctgtcttacgatgggatagactactctaaccaacataagacgggccacaacatcgcccgcgtggccataaaaaaaattgtccgtgtgattaaaaagaagcacagatagctggccagtcatatccggagtcatcacgtgtgaacccgtgtagacccccgggttggacacatcggccaaacaaagaaagcggccaatgtacccaggaggaatcataacactaagacgaagatacaacagaataaccccatgagggggaataacaaagttagtaggtgaataaaaacgataaacacccgaaactccctcctgcgtaggcaaaatagcaccctccccttccaaaacaacatatagcgcttccacagcagccatgacaaaagactcaaaacactcaaaagactcagtcttaccaggaaaataaaagcactctcacagcaccagcactaatcagagtgtgaagagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccggtttctcacggtacgtcacttccgcaagaaaagcaaaactacatttcccacatgtgtaaaaacgaaaccccgccccttgtaactgcccacaacttacatcatcaaaacataaactcctacgtcacccgccccgcctctccccgcccacctcattatcatattggccacaatccaaaataaggtatattat

SEQ ID NO: 12 - DNA, 37216 bp, Gorilla beringei beringei
ataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcaccgtcatttgacgcggagggtatttaaacccgctgcgctcctcaagaggccactcttgagtgccagcgagaagagttttctcctctgctccgcttcggtgatcgaaaaatgagacacatagcctgcactccgggtcttttgtccggtcgggcggcggccgagcttttggacgctttgatcaatgatgtcctaagcgatgattttccgtctactacccactttagcccacctactcttcacgaactgtacgatctggatgtactggtggatgtgaacgatcccaacgaggaggcggtttctgcgttttttcccgagtctgcgctgttggccgctcaggagggatttgacctacacactccgccgcctattttagagtctccgctgccggagcccagtggtataccttatatgcctgaactgcttcccgaagtggtagacctgacctgccacgagcctggctttccgcccagcgacgatgagggtgagccttttgttttagactttgctgagatacctgggcacggttgcaggtcttgtgcatatcatcagagggttaccggagaccccgaggttaagtgttcgctgtgctatatgaggatgacctcttcctttatctacagtaagtttttgtctaggtgggcttttgggtaggtgggttttgtgtcagaacaggtgtaaacgttgcttgtgttttttgtacctgtaggtccggtgtccgagccagacccggagcccgaccgcgatcccgagccggatcccgagcctcctcgcaggacaaggaaactaccttccattctgtgcaagtctcagacacctgtaaggaccagcgaggcagacagcaccgactctggcacttctacctctccccctgaaattcacccagtggttcctctgggtatacataaacctgttgctgttaaagtttgcgggcgacgccctgcagtacagtgcattgaggacttgcttcacgatcccgaggaacctttggacttgagccttaaacgccctaggcaataaaccccacctaagtaataaaccccacctaagtaataaaccctgccgcccttggttattgagatgacgcccaatgtttgcttttgaatgacttcatgtgtgtaataaaagtgagtgtgatcataggtctcttgtttgtctgggcggggcttaagggtatataagtctcttggggctaaacttggttacacttgaccccaatggaggcgtgggggtgcttggaggagtttgcggacgtgcgccgtttgctggacgagagctctagcaatacctatactatttggaggtatctgtggggctctactcaggccaagttggtttccagaattaagcaggattacaagtgcgattttgaagagctttttagttcctgcggtgagcttttgcaatccttgaatctgggccatcaggctattttccaggaaaaggttctctcgactttggatttttccactcccgggcgcaccgccgcttgtgtggcttttgtgtcttttgtgcaagataaatggagcgaggagacccacctgagtcacggctacgtactggatttcatggcgatggctctttggagggctcacaacaaatggaagattcagaaggaactgtacggttccgccctacgtcgtccacttctgtcgcgacaggggctgaggtttcccgaccatcggcagcatcagaatctggaagacgagtcggaggagcgagcggaggagaagatcagcttgagagccggcctggaccctcctcaggaggaatgaatctcccgcaggtggttgacctgtttccagaactgagacgggtcctgactatcagggaggatggtcagtttgtgaagaagtttaagagggatcggggtgagggagatgatgaggcggctagcaatttagcttttagtctgatgactcgccaccgaccggaatgtattacctatcagcagattaaggagagttgtgccaacgagctggatcttttgggtcagaagtatagcatagaacagcttaccacttactggcttcagcctggggatgattgggaagaggcgatcagggtgtatgcaaaggtggccctgcggcccgattgcaagtataagattactaagttggttaatattagaaactgctgctatatttctgggaacggggccgaagtggagatagatactcaggacagggtggcttttaggtgttgcatgataaacatgtggcccgggatactggggatggatggggtggtattcatgaatgtgaggtttacgggccccaactttaatggcacggtgttcatgggcaacaccaacttgctcctgcatggtgcgagtttctatgggtttaataacacctgtatagaggcctggaccgatgtaaaggttcgaggttgttccttttatagctgttggaaggcggtggtgtgtcgccctaaaagcaggggttctgtgaaaaaatgcttgtttgaaaggtgcaccttaggcatcctctctgagggcaactccagggtgcgccataatgtggcttcgaactgcggttgcttcatgcaagtgaagggggtgagcgttatcaagcataactcggtgtgtggaaactgcgaggatcgcgcctcccagatgctgacctgctttgatggcaactgtcacctgttgaagaccattcatataagcagccaccccagaaaggcctggcccgtgtttgagcataacatcttgacccgctgctccttgcatctgggggtcaggaggggtatgttcctgccttaccagtgtaactttagccacactaaaatcctgctggaacccgagtgcatgaccaaggtcagcctgaatggtgtgtttgatgtgactctgaaaatctggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgcaccagggccgagtttgggtctagcgatgaggataccgattgaggtgggtaaggtgggcgtggctagaagggtggggcgtgtataaattgggggtctaagggtctctctgttttgtcttgcaacagccgccgccatgagcgacaccggcaacagctttgatggaagcatctttagcccctatctgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcggcgcggcctctcgcgcgtctgctcgggatgagaaactgaccgctctgctgcttaaactggaagacttgacccgggagctgggtcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataggacatctttacgaatcgggggcggagggtcccggactgggggatgatggtaccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagcctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcgccctttcatcttcactctcttccgcatcgctgtctgcgagggccagctgctggggtaagtattccctctcgaaggcgggcatgacctcagcgctcaggttgtcagtttctaaaaatgaggaggatttgatgttcacctgtccggaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggattaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaaggaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacaggcatgggcggcaggggcacgtcttcgccgcgcgcgggcaggggctggtgctggctccgaagagcgcttgcgtgcgcgacgacgcgacggttggtgtcctgtatctgacgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcttcctggagatctcctcgtccggcgcgctccacggtggccgccaggtcgttggagatgcgacccatgagctgtgagaaggcgttgagcccgccctcgttccagacccggctgtagaccacgcccccctcggcgtcgcgagcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgttgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgagcggccgtgaggtagcgagacggcgctgactatgcatcttaacaattgctgtgtaggtacaccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcatgaggcggtggtatccgtagatgtacctggacatccaggtgatgccggcggcggtggtggtggcgcgcgcgtagtcgcggacccggttccagatgtttcgcaggggcgagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttgaatcggccggaaccgcggctaacgagggccgtggcagccccgtcctcaggaccccgccagccgacttctccagttacgggagcgagccccttttgttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtaaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggccgatgaccaggaagaggaggactatgagctagaggagggcgagtacctggaggactgacctggctggtggtgttttggtatagatgcaagatccgaacgtggcggacccggcggtccgggcggcgctgcaaagccagccgtccggcattaactcctctgacgactgggccgcggccatgggtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggacgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttcaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggagacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacccaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgtttatcaaccgcctgatggactacttgcatcgggcggcggccgtgaaccccgagtacttcactaatgccattctgaatccccactggatgccccctccgggtttctacaacggggactttgaggtgcccgaggtcaacgacgggttcctctgggatgacatggatgacagtgtgttctcacccaacccgctgcgcgccgcgtctctgcgattgaaggagggctctgacagggaaggaccgaggagtctggcctcctccctggctctgggagcggtgggcgccacgggcgcggcggcgcggggcagtagccccttccccagcctggcagactctctgaacagcgggcgggtgagcaggccccgcttgctaggcgaggaggagtatctgaacaactccctgctgcagcccgcgagggacaagaacgctcagcggcagcagtttcccaacaatgggatagagagcctggtggacaagatgtccagatggaagacgtatgcgcaggagtacaaggagtgggaggaccgccagccgcggcccttgccgccccctaggcagcgctggcagcggcgcgcgtccaaccgccgctggaggcaggggcccgaggacgatgatgactctgcagatgacagcagcgtgttggacctgggcgggagcgggaaccccttttcgcacctgcgcccacgcctgggcaagatgttttaaaagaaaaaaaaaaataaaactcaccaaggccatggcgacgagcgttggttttttgttcccttccttagtatgcggcgcgcggcgatgttcgaggaggggcctcccccctcttacgagagcgcgatggggatttctcctgcggcgcccctgcagcctccctacgtgcctcctcggtacctgcaacctacaggggggagaaatagcatctgttactctgagctgcagcccctgtacgataccaccagactgtacctggtggacaacaagtccgcggacgtggcctccctgaactaccagaacgaccacagcgattttttgaccacggtgatccaaaacaacgacttcaccccaaccgaggccagcacccagaccataaacctggataacaggtcgaactggggcggcgacctgaagaccatcttgcacaccaacatgcccaacgtgaacgagttcatgttcaccaactcttttaaggcgcgggtgatggtggcgcgcgagcagggggaggcgaagtacgagtgggtggacttcacgctgcccgagggcaactactcagagaccatgactctcgacctgatgaacaatgcgatcgtggaacactatctgaaagtgggcaggcagaacggggtgaaggaaagcgatatcggggtcaagtttgacaccagaaacttccgtctgggctgggaccccgtgaccgggctggtcatgccgggggtctacaccaacgaggcctttcatcccgacatagtgcttctgcccggctgtggggtggacttcacccagagccggctgagcaacctgctgggcattcgcaagcggcagcctttccaggagggtttcaagatcacctatgaggatctgaaggggggcaacattcccgcgctccttgatctggacgcctacgaggagagcttgaaacccgaggagagcgctggcgacagcggcgagagtggcgaggagcaagccggcggcggtggcggcgcgtcggtagaaaacgaaagtacgcccgcagtggcggcggacgctgcggaggtcgagccggaggccatgcagcaggacgcagaggagggcgcacaggagggcgcgcagaaggacatgaacgatggggagatcaggggagacacattcgccacccggggcgaagaaaaagaggcagaggcggcggcggcggcgacggcggaggccgaaaccgaggttgaggcagaggcagagcccgagaccgaagttatggaagacatgaatgatggagaacgtaggggcgacacgttcgccacccggggcgaagagaaggcggcggaggcagaagccgcggctgaggaggcggctgcggctgcggccaagactgaggctgcggctaaggctgaggtcgaagccaatgttgcggttgaggctcaggctgaggaggaggcggcggctgaagcagttaaggaaaaggcccaggcagagcaggaagagaaaaaacctgtcattcaacctctaaaagaagatagcaaaaagcgcagttacaacgtcatcgagggcagcacctttacccagtaccgcagctggtacctggcgtacaactacggcgacccggtcaagggggtgcgctcgtggaccctgctctgcacgccggacgtcacctgcggctccgagcagatgtactggtcgctgccgaacatgatgcaagacccggtgaccttccgctccacgcggcaggttagcaacttcccggtggtgggcgccgaactgctgcccgtgcactccaagagtttttacaacgagcaggccgtctactcccagctgatccgccaggccacctctctgacccacgtgttcaatcgctttcccgagaaccagattttggcgcgcccgccggcccccaccatcaccaccgtgagtgaaaacgttcctgccctcacagatcacgggacgctaccgctgcgcaacagcatctcaggagtccagcgagtgaccattactgacgccagacgccggacctgcccctacgtttacaaggccttgggcatagtctcgccgcgcgtcctctccagtcgcactttttaaaacacatctacccacacgttccaaaatcatgtccgtactcatctcacccagcaacaacaccggctgggggctgcgcgcgcccagcaagatgtttggaggggcgaggaagcgctccgaccagcaccctgtgcgcgtgcgcggccactaccgcgcgccctggggagcgcacaagcgcgggcgcacagggcgcaccactgtggacgacgtcattgactccgtagtggagcaagcgcgccactacacacccggcgcgccgaccgcccccgccgtgtccaccgtggaccaggcgatcgaaagcgtggtacagggcgcgcggcactatgccaaccttaaaagtcgccgccgccgcgtggcccgccgccatcgccggagaccccgggccaccgccgccgcgcgccttactaaggctctgctcaggcgcgccaggcgaactggccaccgggccgccatgagggccgcacggcgggctgccgctgccgcaagcgtcgtggccccgcgggcacgaaggcgcgcggccgctgccgccgccgccgccatttccagcttggcctcgacgcggcgcggtaacatatactgggtgcgcgactcggtaaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgacgaggcggtggagtttgtccgccgcatggcacccaggcgccccgtgcagtggaagggccggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtaaccctgcaacaggtgctgcctttgagcgcgcccagcgagcataagcgagggttgaagcgcgaaggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcggcggccagcgccaccaccggcaccgcttcggtagaggtgcagacggacccctggctacccgccaccgctgttgccgccgccgccccccgttcgcgcgggcgcaagagaaattatccagcggccagcgcgctcatgccccagtacgcactgcatccatccatcgtgcccacccccggctaccgcgggtactcgtaccgcccgcgcagatcagccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcattttttggaggaaaaaataaaaaaaaagtctagactctcacgctcgcttggtcctgtgactattttgtagaaaaaaagatggaagacatcaactttgcgtcgctggccccgcgtcacggctcgcgcccgttcatgggagactggacagatatcggcaccagcaatatgagcggtggcgccttcagctggggcagtctgtggagcggccttaaaaattttggttccaccattaagaactatggcaacaaagcgtggaacagcagcacgggccagatgctgagagacaagttgaaagagcagaacttccaggagaaggtggcgcagggcctggcctctggcatcagcggggtggtggacatagctaaccaggccgtgcagaaaaagataaacagtcatctggacccccgtcctcaggtggaggaaatgcctccagcgatggagacggtgtctcccgagggcaaaggcgaaaagcgcccgcggcccgacagagaagagaccctggtgtcacacaccgaggagccgccctcttacgaggaggcagtcaaggccggcctgcccaccactcgccccatagcccccatggccaccggtgtggtgggccacaggcaacacactcccgcaacactagatctgcccccgccgtccgagccgccgcgccagccaaaggcggcgacggtgcccgctccctccacttccgccgccaacagagtgcccctgcgccgcgccgcgagcggcccccgggcctcgcgagttagcggcaactggcagagcacactgaacagcatcgtgggcctgggagtgaggagtgtgaagcgccgccgttgctactgaatgagcaagctagctaacgtgttgtatgtgtgtatgcgtcctatgtcgccgccagaggagctgttgagccgccggcgccgtctgcactccagcgaatttcaagatggcgaccccatcgatgatgcctcagtggtcgtacatgcacatctcgggccaggacgcttcggagtacctgagccccgggctggtgcagttcgcccgcgccacagacacctacttcaacatgagtaacaagttcaggaaccccactgtggcgcccacccacgatgtgaccacggaccggtcgcagcgcctgacgctgcggttcatccccgtggatcgggaggacaccgcctactcttacaaggcgcggttcacgctggccgtgggcgacaaccgcgtgctggacatggcctccacttactttgacatcaggggggtgctggacaggggccccaccttcaagccctactcgggtactgcctacaactccctggcccccaagggcgctcccaattcttgcgagtgggaacaagatgaaccagctcaggcagcaatagctgaagatgaagaagaacttgaagaagaacaagctcaggacgaacaggcgcccactaagaaaacccatgtatacgcccaggcacctctttctggtgaaaaaattactaaggatggtttgcaaataggtgtggatgccacacaggcgggagataaccctatatatgctgataaaacattccaacccgaacctcagataggtgagtctcagtggaacgaggctgatgccacagtagcaggaggcagagtcttaaaaaagaccacccctatgagaccttgctatggatcctatgccaaacctactaatgccaatggcggtcaagggatcatggtggccaatgatcagggagcgcttgaatctaaagttgagatgcaatttttctccaccacaacgtctcttaatgtaagggaaggtgaaaacaatcttcagccaaaagtagtgctatacagcgaagatgttaacttggaatcccctgacactcatttgtcttacaaacctaaaaaggatgacaccaactctaaaatcatgttgggtcagcaagccatgcccaacagacccaacctcattgcttttagggacaactttattggacttatgtactacaacagcacaggcaacatgggagtgctggcaggacaggcctcccagctaaacgctgtggtagacttgcaagacagaaacacagagctgtcataccaactgatgcttgattccattggagacagatcaagatacttttccatgtggaaccaggcagtggacagctatgacccagatgtcagaatcattgaaaaccatggggttgaagatgagctgcccaactattgctttcccctgggcggtattggaattacagacacataccagtgcataaaaccaaccgcagctgctaataacactacatggtctaaggatgaagaatttagtgatcgcaatgaaataggggtgggaaacaacttcgccatggagatcaacatccaggccaacctctggaggaacttcctctatgcgaacgtggggctctacctgccagacaagctcaagtacaaccccaccaacgtggacatctctgacaaccccaacacctatgactacatgaacaagcgtgtggtggctcccggcctggtggactgctttgtcaatgtgggagccaggtggtccctggactacatggacaacgtcaaccccttcaaccaccaccgcaatgcgggtctgcgctaccgctccatgatcctgggcaacgggcgctacgtgcccttccacattcaggtgccccagaagttctttgccatcaagaacctcctcctcctgccgggctcctacacttacgagtggaacttcaggaaggatgtcaacatggtcctgcagagctctctgggcaatgaccttagggtggacggggccagcatcaagtttgacagcgtcaccctctatgctaccttcttccccatggctcacaacaccgcctccacgctcgaggccatgctgaggaacgacaccaacgaccagtccttcaatgactacctctctggggccaacatgctctaccccatccccgccaaggccaccaacgtgcccatctccattccctctcgcaactgggccgccttcagaggctgggcctttacccgccttaagaccaaggaaaccccctccctgggctcgggttttgacccctactttgtctactcgggatccatcccctacctggatggcaccttctacctcaaccacacttttaagaagatatccatcatgtatgactcctccgtcagctggccgggcaatgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccattggcatcactcaccagcacaacaactcgggattcgtgggctacctggctcccaccatgcgcgaggggcaggcctaccccgccaacttcccctacccgttgataggcaaaaccgcggtcgacagcgtcacccagaaaaagttcctctgcgaccgcaccctctggcgcatccccttctctagcaacttcatgtccatgggtgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacctgctacctcttcgacccctttggcttctccgatcagcgcctcagacagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcacatccggggggccacctctttctgccacttgcaagaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttaaactcgggcaccaccatgcggggcagtggttcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattatgcacgctggccagcaggctctcgtcgctgatcatgtcgctgtccagatcctccgcgttgctcagggcgaacggggtcatcttgcagacctgcctgcccaggaaaggcggcagcccgggcttgccgttgcagtcgcagcgcaggggcatcagcaggtgcccgcggcccgactgcgcctgcgggtacagcgcgcgcatgaaggcttcgatctgcctgaaagccacctgcgtcttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtaccgtgcagacacttcaggtcgccctccgtctgggtgcagcggtgctcccacagcgcgcaaccggtgggctcccaatttttgtgggtcacccccgcgtaggcctgcaggtaggcctgcaagaagcgccccatcatggccacaaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagcgccgcctgctcttcttcgtcttcgctgtctaccactatctctggggaagggcttctccgctctgcggcggcgcgcttcttttttttcttgggagcggccgtgatggagtccgccacggcgacggaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcttctcgagctggtcttggtcccgactggccattgtatcctcctcctcctaggcagagagacataaggagtctatcatgcaagtcgagaaggaggagagcttaaccaccccctctgagaccgccgatgcgcccgccgtcgccgtcgcccccgctgccgccgacgcgcccgccacaccgagcgacacccccgcggacccccccgccgacgcacccctgttcgaggaagcggccgtggagcaggacccgggctttgtctcggcagaggaggatttgcgagaggaggaggataaggagaagaagccctcagtgccaaaagatgataaagagcaagacgagcacgacgcagatgcacaccagggtgaagtcgggcggggggacggagggcatgacggcgccgactacctagacgaagggaacgacgtgctcttgaagcacctgcatcgtcagtgcgccattgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgcctttgtggtacccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtaccaaagatcttcgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctaaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgtggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgcctggaggagcgcaacctcaaggagctggagaagctcctgcagcgcgcgctcaaagatctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaagaccaatcccgcccgcccaaggcggagctgaccgcctgcgtcatcacccagggcgagatcctaggccaattgcaagccatccaaaaagcccgccaagactttttgctgaagaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcaattaccaccacgccccgcaataatcccaaccccagggagtggcccgcgtccctggtgtatcaggaaattcccggccccaccaccgtactacttccgcgtgattcccaggccgaagtccaaatgactaactcaggggcacagctcgcgggcggctgtcgtcacagggtgcggcctcctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcaaagctcgtcctcggcgccgcgctcgggcggcatcgggactctccagttcgtgcaggagtttgtgccctcggtctacttcaaccccttctcgggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgaggaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacgagagttaacacttgtggggtttctggtgtatgtgacgctggtggtggctcttttgattaaggcttttccttccatgtctgaactctccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgactttatagagccccagtgtaatgtgacttttaaagcccatgcacagcgttgtcatactataatcaaatgtgccaccgaacacgatgaataccttatccagtataaagataaatcacacaaagtggcacttgttgacatctggaaacccgaagaccctttggaatacaatgtgaccgttttccagggtgacctcttcaaaatttacaattacactttcccatttgaccagatgtgtgactttgtcatgtacatggaaaagcagcacaagctgtggcctccgactccccagggctgtgtggaaaatccaggctctttctgcatgatctctctctgtgtaactgtgctggcactaatactcacgcttttgtatatcagatttaaatcaaggcaaagcttcattgatgaaaagaaaatgccttaatcgctttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaatagccacaagcccagagccatctgcgatgggcaaaatctaaccttgattgatgttcaattgctggatgcgggctactattatgggcagctgggtacaatgattaattactggagaccccacagagattacatgctccacgtagtaaagggtccccttagcagcccacccactaccacctctactacccccactaccaccactactcccaccaccagcactgccgcccagcctcctcatagcagaacaaccacttttatcaattccaagtcccactccccccacattgccggcgggccctccgcctcagactccgaaaccaccgagatctgcttctgcaaatgctctgacgccattgcccaggatttggaagatcacgaggaagatgagcatgacttcgcagatgcatgccaggcatcagagccagaagcgctgccggtggccctcaaacagtatgcagacccccacaccacccccgaccttcctccaccttcccagaagccaagtttcctgggggaaaatgaaactctgcctctctccatactcgctctgacatctgttgctatgttgaccgctctgctggtgcttctatgctctatatgctacctgatctgctgcagaaagaaaaaatctcacggccatgctcaccagcccctcatgcacttcccttaccctccagagctgggcgaccacaaactttaagtctgcagtaactatctgcccatcccttgtcagtcgacagcgatgagccccactaatctaacggcctctggacttacaacatcgtctcttaatgagaccaccgctcctcaagacctgtacgatggtgtctccgcgctggttaaccagtgggatcacctgggcatatggtggctcctcataggagcagtgaccctgtgcctaatcctggtctggatcatctgctgcatcaaaagcagaagacccaggcggcggcccatctacaggccctttgtcatcacacctgaagatgatgatgacaccacttccaggctgcagaggctaaagcagctactcttctcttttacagcatggtaaattgaatcatgcctcgcattttcatctacttgtctctccttccactttttctgggctcttctacattggccgctgtgtcccacatcgaggtagactgcctcacgcccttcacagtctacctgcttttcggctttgtcatctgcacctttgtctgcagcgttatcactgtagtgatctgcttcatacagtgcatcgactacgtctgcgtgcgggtggcttactttagacaccacccccagtatcgcaacagggacatagcggctctcctaagacttgtttaaaatcatggccaaattaactgtgattggtcttctgatcatctgctgcgtcctagccgcgattgggactcaagctcctaccaccaccagcgctcccagaaagagacatgtatcctgcagcttcaagcgtccctggaatataccccaatgctttactgatgaacctgaaatctctttggcttggtacttcagcgtcaccgcccttcttatcttctgcagtacggttattgcccttgccatctacccttcccttgacctgggctggaatgctgtcaactctatggaatatcccaccttcccagaaccagacctgccagacctggttgttctaaacgcgtttcctcctcctgctcccgttcaaaatcagtttcgccctccgtcccccacgcccactgaggtcagctactttaatctaacaggcggagatgactgaaaacctagacctagaaatggacggtctctgcagcgagcaacgcacactagagaggcgccggcaaaaagagctcgagcgtcttaaacaagagctccaagacgcggtggccatacaccagtgcaaaaaaggtgtcttctgtctggtaaaacaggccacgctcacctatgaaaaaacaggtgacacccaccgcctaggatacaagctgcccacacagcgccaaaagttcgccctcatgataggcgaacaacccatcaccgtgacccagcactccgtggagacagaaggctgcatacatgctccctgtaggggcgctgactgcctctacaccttgatcaaaaccctctgcggtctcagagaccttatccctttcaattaatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtccctttccttacccctccctttgtgtcatccgcaggaatgcaagaaaatccagctggggtgctgtccctgcacttgtcagagccccttaccacccacaatggggccctgactctaaaaatggggggcggcctgaccctggacaaggaagggaatctcacttcccaaaacatcaccagtgtcgatccccctctcaaaaaaagcaagaacaacatcagccttcagaccgccgcacccctcgccgtcagctccggggccctaacactttttgccactccccccctagcggtcagtggtgacaaccttactgtgcagtctcaggcccctctcactttggaagactcaaaactaactctggccaccaaaggacccctaactgtgtccgaaggcaaacttgtcctagaaacagaggctcccctgcatgcaagtgacagcagcagcctgggccttagcgttacggccccacttagcattaacaatgacagcctaggactagatctgcaggcacccattgtctctcaaaatggaaaactggctctaaatgtagcaggccccctagctgtggccaatggcattaatgctttgacagtaggcacaggcaaaggtattggtctaaatgaaaccagcactcacttgcaagcaaagttggtcgcccccctaggctttgataccaatggcaacattaagctaagcgttgcaggaggcatgagactaaataatgacacacttatactagatgtaaactacccatttgaagctcaaggccaactaagtctaagagtgggccagggtccgctgtatgtagattctagcagccataacctgaccattagatgccttagaggattatacataacatcgtctaataaccaaaccggtctagaggccaacataaaactaacaaaaggccttgtctatgatggaaatgccatagcagtcaatgttggtcaaggattgcaatacagcactactgccacatcggaaggtgtgtatcctatacagtctaagataggtttgggaatggaatatgataccaacggagccatgatgacaaaactaggctctggactaagctttgacaattcaggagccattgtagtgggaaacaaaaatgatgacaggcttactctgtggactacaccagacccatctcctaactgtagaatttattctgaaaaagatactaaactaaccttggtgctgactaagtgtggcagccaaatcctaggcacagtatctgcccttgctgtcagaggcagccttgcgcccatcactaatgcatccagcatagtccaaatatttctaagatttgatgaaaatggactattgatgagcaactcatcgctagacggtgattactggaattacagaaatggggactccactaatagcacaccatatacaaatgcagtaggctttatgcctaatctagcagcctatcctaaaggtcaggctacagctgcaaaaagcagtattgtaagccaggtatacatggatggtgacactactaaacctataacactaaaaataaacttcaatggcattgatgaaacaacagaaaatacccctgttagtaaatattccatgacattctcatggagctggcccaccgcaagctacataggccacacttttgcaacaaactcttttactttctcctacatcgcccaagaataaagaaagcacagagatgcttgttttgatttcaaaattgtgtgcttttatttattttcagcttacagtatttccagtagtcattcgaataaagcttaatcaaactgcatgagaacccttccacatagcttaaattagcaccagtgcaaatggagaaaattcaacataccttttttatccagatatcagagaactctagtggtcagttttcccccaccctcccagctcacagaatacacagtcctttccccccggctggctttaaacaacactatctcattggtaacagacatattcttaggtgtaataatccacacggtctcttggcgggccaagcgctggtcggtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgcagcaacaaggcgcgcagcaactcctgccgccgcctctccgtacgacaggaatgcaacggcgtggtggtctcctccgcgataatccgcaccgctcgcagcatcagcatcctcgtcctccgggcacagcagcgcatcctgatctcactgagatcggcgcagtaagtgcagcacaaaaccaagatgttatttaagatcccacagtgcaaagcactgtacccaaagctcatggcgggaaggacagcccccacgtgaccatcataccagatccttaggtaaatcaaatgacgacctctcataaacacgctggacatgtacatcacctccttgggcatgcgctgattcaccacctctcgataccacaagcatcgctgattaattaaagacccctcaagcaccatcctgaaccaggaagccagcacctgaccccccgccaggcactgcagggaccccggtgaattgcagtggcagtgaagactccagcgctcgtagccgtgaaccatagagccggtcattatatccacattggcacaacacaaacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagctcgcgtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgctcggtgtagtagttgtaatacagccactccctcagaccgtcaaggcgctccctggcgtccggatctataacaacaccgtcctgcagcgccgccctgatgacatccaccaccgtagagtatgccaagcccagccaggaaatgcattcactttgacagcgagagataggaggagcgggaagagatggaagaaccatgatagtaaaagacttttattccaatcgatcctctacaatgtcaaagtgtagatctataagatgacactggtctcctccgctgagtcgatcaaaaataacagctaaaccacaaacaacacgattggtcaaatgctccacaagggcttgcagcataaaatcgcctcgaaagtccaccgcaagcataacatcaaagccaccgcccctatcatgatctataataaaaaccccacagctatccaccagacccataaagttttcatctctccatcgtgaaaaaatatttacaagctcctcctttaaatcacctccaaccaattgaaaaagttgagccaaaccgccctccaccttcattttcagcaagcgcatcatgattgcaaaaattcaggctcctgagacacctgtataagattgagaagcggaacgttaacgtcaatgtttcgctcgcgaagatcgcgcctcagtgcaagcatgatataatcccacaggtcggagcggatcagcgaggacatctccccgccaggaaccaactcaacggagcctatgctgattataatacgcatattcggggctatgctgaccagcacggcccccaaataggcgtactgcataggcggcgacaaaaagtgaacagtttgggttaaaaaatcaggcaaacagtcgcgcaaaaaagcaagaacatcataaccatgctcatgcaaatagatgcaagtaagctcaggaacgaccacagaaaaatgcacaatttttctctcaaacatgactgcgagccctgcaaaaaataaaaaagaaacattacacaagagtagcctgtcttacgatgggatagactactctaaccaacataagacgggccacaacatcgcccgcgtggccataaaaaaaattgtccgtgtgattaaaaagaagcacagatagctggccagtcatatccggagtcatcacgtgtgaacccgtgtagacccccgggttggacacatcggccaaacaaagaaagcggccaatgtacccaggaggaatcataacactaagacgaagatacaacagaataaccccatgagggggaataacaaagttagtaggtgaataaaaacgataaacacccgaaactccctcctgcgtaggcaaaatagcaccctccccttccaaaacaacatatagcgcttccacagcagccatgacaaaagactcaaaacactcaaaagactcagtcttaccaggaaaataaaagcactctcacagcaccagcactaatcagagtgtgaagagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccggtttctcacggtacgtcacttccgcaagaaaagcaaaactacatttcccacatgtgtaaaaacgaaaccccgccccttgtaactgcccacaacttacatcatcaaaacataaactcctacgtcacccgccccgcctctccccgcccacctcattatcatattggccacaatccaaaataaggtatattat

SEQ ID NO: 13 - DNA, 37073 bp, Gorilla beringei graueri
catcatcaataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcaccgtcatttgacgcggagggtatttaaacccgctgcgctcctcaagaggccactcttgagtgccagcgagaagagttttctcctctgctccgcttcggtgatcgaaaaatgagacacatagcctgcactccgggtcttttgtccggtcgggcggcggccgagcttttggacgctttgatcaatgatgtcctgagcgatgattttccgtctactacccactttagcccacctactcttcacgaactgtacgatctggatgtactggtggatgtgaacgatcccaacgaggaggcggtttctgcgttttttcccgagtctgcgctgttggccgctcaggagggatttgacctacacactccgccgcctattttagagtctccgctgccggagcccagtggtataccttatatgcctgaactgcttcccgaagtggtagacctgacctgccacgagcctggctttccgcccagcgacgatgatggtgagccttttgttttagactttgctgagatacctgggcacggttgcaggtcttgtgcatatcatcagagggttaccggagaccccgaggttaagtgttcgctgtgctatatgaggatgacctcttcctttatctacagtaagtttttgtctaggtgggcttttgggtaggtgggttttgtgtcagaacaggtgtaaacgttgcttgtgttttttgtacctgtaggtccggtgtccgagccagacccggagcccgaccgcgatcccgagccggatcccgagcctcctcgcaggacaaggaaactaccttccattctgtgcaagtctcagacacctgtaaggaccagcgaggcagacagcaccgactctggcacttctacctctccccctgaaattcacccagtggttcctctgggtatacataaacctgttgctgttagagtttgcgggcgacgccctgcagtacagtgcattgaggacttgcttcacgatcccgaggaacctttggacttgagccttaaacgccctaggcaataaaccccacctaagtaataaaccccacctaagtaataaaccctgccgcccttggttattgagatgacgcccaatgtttgcttttgaatgacttcatgtgtgtaataaaagtgagtgtgatcataggtctcttgtttgtctgggcggggcttaagggtatataagtttctcggggctaaacttggttacacttgaccccaatggaggcgtgggggtgcttggaggagtttgcggacgtgcgccgtttgctggacgagagctctaaccatacctatactatttggaggtatctgtggggctctactcaggccaagttggtctccagaattaagcaggattacaagtgcgattttgaagagctttttagttcctgcggtgagcttttgcaatccttgaatctgggccatcaggctattttccaggaaaaggttctctcgactttggatttttccactcccgggcgcaccgccgcttgtgtggcttttgtgtcttttgtgcaagataaatggagcgaggagacccacctgagtcacggctacgtactggatttcatggcgatggctctttggagggctcacaacaaatggaagattcagaaggaactgtacggttccgccctacgtcgtccacttttgtcgcgacaggggctgaggtttcccgaccatcggcagcatcagaatctggaagacgagtcggaggagcgagcggaggagaagatcagcttgagagccggcctggaccctcctcaggaggaatgaatctcccgcaggtggttgacctgtttccagaactgagacgggtcctgactatcagggaggatggtcagtttgtgaagaagtttaagagggatcggggtgagggagatgatgaggcggctagcaatttagcttttagtctgatgactcgccaccgaccggaatgtattacctatcagcagattaaggagagttgtgccaacgagctggatcttttgggtcagaagtatagcatagaacagcttaccacttactggcttcagcctggggatgattgggaagaggcgatcagggtgtatgcaaaggtggccctgcggcccgattgcaagtataagattactaagttggttaatattagaaactgctgctatatttctgggaacggggccgaagtggagatagatactcaggacagggtggcttttaggtgttgcatgataaacatgtggcccgggatactggggatggatggggtggtgttcatgaatgtgaggtttacgggccccaactttaatggcacggtgttcatgggcaacaccaacttgctcctgcatggtgcgagtttctatgggtttaataacacctgtatagaggcctggaccgatgtaaaggttcgaggttgttccttttatagctgttggaaggcggtggtgtgtcgccctaaaagcaggggttctgtgaaaaaatgcttgtttgaaaggtgcaccttaggcatcctctctgagggcaactccagggtgcgccataatgtggcttcgaactgcggttgcttcatgcaagtgaagggggtgagcgttatcaagcataactcggtgtgtggaaactgcgaggatcgcgcctcccagatgctgacctgctttgatggtaactgtcacctgttgaagaccattcatataagcagccaccccagaaaggcctggcccgtgtttgagcataacatcctgacccgctgctccttgcatctgggggtcaggaggggtatgttcctgccttaccagtgtaactttagccacactaaaatcctgctggaacccgagtgtatgaccaaggtcagcctaaatggcgtgtttgatgcgactctgagaatctggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgtaccagggccgagtttgggtctagcgatgaggataccgattgaggtgggtaaggtgggcgtggctagcagggtggggcgtgtataaattgggggtctaagggtctctctgttttgtcttgcaacagccgccgccatgagcgacaccggcaacagctttgatggaagcatctttagcccctatttgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcagcgcggcctctcgcgcgtctgctcgggatgagaaactgaccgctctgctgcttaaactggaagacttgacccgggagctgggtcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataagacatctttacaaatcgggggcggagggtcccggactggggtatgatggtaccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagcctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcgccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtcctgaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaaggaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacgggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcctcctggagatctcctcgtccggcgcgctccacggtggccgccaggtcgttggagatgcgacccatgagctgcgagaaggcgttgagcccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacgccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcataaggcggtggtatccgtagatgtacctggacatccaggtgatgccggcggcggtggtggtggcgcgcgcgtagtcgcggacccggttccagatgtttcgcaggggcaagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgagggccgtggcagccccgtcctcaggaccccgccagccgacttctccagttacgggagcgagccccttttgtttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtgaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggacgatgaccaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgagtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggatgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttgaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggaaacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacgcaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcattaaccgcctgatggactacttgcatcgggcggcggccgtgaaccccgagtacttcactaatgccattctgaatccccactggatgccccctccgggtttctacaacggggacttcgaggtgcccgaggttaacgacgggttcctctgggatgacatggatgacagtgtgttctcacccaacccgctgcgcgccgcgtctctgcgattgaaggagggttctgacagggaaggaccgaggagtctggcctcctccctggctctgggagcggtgggcgcggcggcgcggggcagtagccccttccccagcctggcagactctctgaacagcgggcgggtgagcaggccccgcttgctaggcgaggaggagtatctgaacaactccctgctgcagcccgcgagggacaaaaacgctcagcggcagcagtttcccaacaatgggatagagagcctggtggacaagatgtccagatggaagacgtatgcgcaggagtacaaggagtgggaggaccgccagccgcggcccctgccgccccctaggcagcgctggcagcggcgcgcgtccaaccgccgctggaggcaggggcccgaggacgatgatgactctgcagatgacagcagcgtgctggacctgggcgggagcgggaaccccttttcgcacctgcgcccccgcctgggcaagatgttttaaaagagaaaaaataaaaactcaccaaggccatggcgacgagcgttggttttttgttcccttccttagtatgcgacgcgcggcgatgttcgaggaggggcctcccccctcttacgagagcgcgatgggattttctcctgcgacgcccctacagcctccctacgtgcctcctcggtacctgcaacctaccgggggaagaaatagcatctgttactctgagctgcagcccctgtatgacaccaccaaagtgtacctggtggacaacaagtctgcggacgtggcctccctgaactaccagaacgaccacagcgattttttgaccaccgtgatccaaaacaatgacttcaccccaaacgaggccagcacccagaccataaacctggacaacaggtcgcactggggcggtgatctgaagaccatcttgcacaccaacatgcccaacgtgaatgagtttatgtttactaactcttttaaggcgcgggtaatggtggcgcgcgacgataagggagtgcctaaatacgagtgggtggactttacactgcccgagggcaactactccgagatcatgactcttgacctgatgaacaacgcgatcgtggagcactacttgaaagtaggcaggcagaacggggtaaaagaaagcgatattggagttaagtttgacaccaggaactttcgcctgggatgggaccccgagacggggttggttatgcccggggtttacactaatgaagcttttcaccccgatatagtgctcttgcccggatgcggggtggacttcacccaaagccggctgagcaacctgctgggcattcgaaagcgccagccattccaggaggggtttcaaatcacttatgagcatttggaagggggcaacattccggcgcttctggatttggtcgcctacgaggagagtttgaaatccgaggaaagcggggataacactgacaagggcggcgaggagcaagccggcgatggcgacactgcttcggtagaaaacgaaagtgcgtccgtggtggaggcggcggcggtagcgaccgcagagccggagaccgtagaggaggatatgaatgatagcgcaatcagaggagactcgtttattccccggggcgaagaaaagaaggcggaggctgcggcagcagtcgaagcagagcccaaagtcgagtcggagatcatggaggaggatttgaatgataacgcgatcagaggtgatacgtttgtgccgcggggcgaagaaaaaaaagcggaggcggaggccgcggctgaggaggcggccgaggctgtggcagccaccgcggcggtgactgaaacaactgaggagcaggttcaggccgagcaggttcaaaagaagcccgtgattaaagccctaacacaagatagcaaggagcgcagttacaacttgattcccggtagtactgacaccgagtaccgcagctggtacctggcatacaactacggcgacccggtcaaaggggtgcgctcgtggactctgctttgcacgccggacgtcacctgcggctccgagcagatgtactggtcgttgccaaacatgatgcaagacccggtgaccttccgctccacgcggcaggttaacaacttcccggtggtgggcgccgaactgctgcccgtgcactccaagagcttttacaacgagcaggccgtgtactcccagctgatccgccaggccacctctctgacccacgtgttcaatcgctttcccgagaaccagattttggcgcgcccgccggcccccaccatcactaccgtcagtgaaaacgttcctgctctcacagatcacgggacgctaccgctgcgcaacagcatctcaggagtccagcgagtgaccattactgacgccagacgccggacctgcccctacgtttacaaggccttgggcatagtctcgccgcgcgtcctctccagccgcactttttaaaacacatattcacccacgcttcaaagattatgtctatacttatctcacccagcaataacaccggctgggggctgcgcgcgcccagcaagatgtttggaggggcgagaaaacgttccgagcagcacccagtgcgcgtgcgcggccactaccgcgcgccctggggagcgcacaagcgcgggcgcgcagggcgcaccactgtggacgacgccattgactccgtagtggagcaggcgcgccactacacacccggcgcgccgtccgcccccgccgtgtccaccgtggacgaggcgatcgaaagcgtggtacagggcgcgcggcactatgccaaccttaaaaatcgccgccgtcgcgtggcccgccgccatcgccggagaccccgggccaccgccgccgcgcgccttgctaaggctctactcaggcgcgccaggcgaactggccgccgggccgccatgagggccgcacggcgggctgccgccagtgcggccgccgcggccccacgggcacgaaggcgcgcggccgctgccgccgccgccgccatttccagcttggcctcaacgcggcgcggtaacatatactgggtgcgcgactcgataaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgatgacgaggcggtggagtttgtccgccgcatggcacccaggcgccccgtgcagtggaagggtcggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtgaccctgcaacaggtgctgcctttgagcgcgcccagcgagcataagcgagggttgaagcgcgagggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcagcggccagcgccaccaccggcaccgcttcggtagaggtgcagacggacccctggctacccgccgccgctgtcgccgccgccgccgccccccgttctcgcgggcgcaagagaaattatccagtggccagcgcgctcatgccccagtacgcactgcatccatccatcgcgcccacccccggctaccgcgggtattcgtaccgcccgcgcagatcggccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcatttttttggaggaaaaataaaaaagtctagactctcacgctcgcttggtcctgtgactattttgtagaaaaaagatggaagacatcaactttgcgtcgctggccccgcgtcatggctcgcgcccgttcatgggagactggacagatatcggcaccagcagtatgagcggtggcgccttcagctggggcagtctgtggagcggccttaaaaattttggttccaccattaaaaactatggcaacaaagcgtggaacagcagcacgggccagatgctaagagacaagttgaaagagcagaacttccaggagaaggtggcgcagggcctggcctctggcatcagcggggtggtggacatagctaaccaggccgtgcagaaaaagataaacagtcatctggacccccgccctcaggtggaggaaacgcctccagccatggagacggtgtttcccgagggcaaaggcgaaaagcgcccgcggcccgacagggaagagaccctggtgtcacacaccgaggagccgccctcttacgaggaggcactcaaggccggcctgcccaccactcgccccgtagctcccatggccacaggtgtggtgggccataaacaacacacccccgcaacactagatctgcccccgccgtccgagccgccgcgtcagccaaagacggcgacggtgcccgctccctccacttccgccgccaacagagtgtccctgcgccgcactacgggcgcccctcggggaccgcgactgagcggcaactggcagagcacactgaacagcattgtgggcctgggagtgaaaagtgtgaagcgccgccgttgctactgaatgagcaagctagctaacgtgttatatgtgtgtatgcgtcctatgtcgccgccagaggagctgttgagccgcccgcgccgtctgcactccagcgaatttcaagatggcgaccccttcgatgatgccacagtggtcgtacatgcacatctcgggccaggacgcctcggagtacctgagccccgggctggtgcagttcgcccgcgccaccgacagctacttcagcctaagtaacaaatttaggaaccctacggtggcacccacccacgatgtgaccacggaccggtcgcagcgcctgacgctgcggtttatccccgtggatcgggaggacactgcctactcttacaaggcgcgcttcacgctagccgtgggcgacaaccgcgtgctggacatggcctccacctactttgatatccggggtgtgctggacaggggtcccacctttaagccctactcgggcactgcctacaactccctggctcctaaaggcgctcccaattcttgcgagtgggatgaaaaaactaatactgctgaagcagccattgaaaatgaagaagagctggcggatgagccagaagagcaagcagaagaggctataaaaaccaatgtgtttgcccaggcgccatattctggcaatgcaatttccaaagaaggaatacaagtaggcatagaaggcattggagagcaagtaaaagccgtatacgcagacaaaacctaccagccggaacctcaggttggagaaactcaatggaatgagactgaaataaatcatggagcaggaagggtgctgaagaagaccactcccatgaagccttgctatggttcttatgctaaacctactaatgaatatggaggccagggcatccttgtagaaaaaaatggcaaaatggaaagccaggtggaaacacagttttttgctcttgacggtgaaaatgataatagtccaaaagtggtgttgtatagcgaagatgtaaacttggatactcctgacacacacctatcatacaaacctagcgcccaagatgtaaactctaaagaaatgttgggccaacaggccatgcccaacaggccaaatcttattgcttttagggacaactttattggacttatgtactacaacagcactggcaacatgggagtgctggcaggacaggcctcccaactaaatgccgtggtagacttgcaagacagaaacacagagttgtcataccagctgatgcttgattccattggagacagatcaagatattttgccatgtggaaccaggcggttgatagttacgatccagatgttagaattattgaaaaccatggcacagaggatgaacttccaaactactgttttcctttgggaggaatatttaatactcagagttttaaaaaggtaaaacctggaacggataacggatgggaaacagatgatgacttttcagataaaaatgaaataagagttggcaacaactttgccatggagatcaatatccaggcaaacctgtggagaagcttcttgtattccaatgtggctctctacctgccagataagatgaagtactctccaaccaacatagacatttccaccaacactaacacctatgactacatgaacaaaagagtggcgcctccaggcctggtggactgctatgtcaatctgggggccaggtggtcccttgatgtaatggataacatgaacccctttaaccaccaccgcaatgcgggcctgcgataccgttccatgcttctgggtaacggccgctacgtgcccttccacatccaggtgccccaaaagttctttgccatcaaaagccttctactcttgcctggctcgtacacctacgaatggaatttcagaaaggatgtgaacatggtcctacagagctctctgggcaacgaccttagggtggatggggccagcatcaagtttgacagcatcaccctttatgctacctttttccccatggcccacaacaccgcttccacgcttgaggccatgctcagaaacgacaccaacgaccagtccttcaatgactacctctctggggccaacatgctctaccccatccccgccaacgctaccaacgtgcccatctccattccctctcgcaactgggccgccttcagaggctgggcatttacccgccttaagaccaaggagaccccctccctgggctcgggttttgacccctactttgtctactcgggatccatcccctacctggatggcaccttctacctcaaccacacttttaagaagatatccatcatgtatgactcctctgtcagctggccgggcaacgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccgttggcatcactcaccagcacaacaactcgggattcgtgggctacctggcacccaccatgcgcgagggacaggcctaccccgccaacttcccctaccccttgataggcaagaccgcggtcgacagcgtcacccagaaaaagttcctctgcgaccgcaccctctggcgcatccccttttctagcaacttcatgtccatgggcgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacttgctacctctttgacccttttggcttctccgatcagcgcctcaagcagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcgcatccggggggccacctctttctgccacttgcaagaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggttcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattatgcacgctggccagcaggctctcgtcgctgatcatgtcgctgtccagatcctccgcgttgctcagggcgaatggggtcatcttgcagacctgcctgcccaggaaaggcggcagcccgggcttgccgttgcagtcgcagcgcaggggcatcagcaggtgcccgcggcccgactgcgcctgcgggtacagcgcgcgcatgaaggcttcgatctgcctgaaagccacctgcgccttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtcccgtgcagacacttcaggtcgccctccgtctgggtgcagcggtgctcccacagcgcgcaaccggtgggctcccaattcttgtgggtcacccccgcgtaggcctgcaggtaggcctgcaagaagcgccccatcatggccacgaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagcgccgcctgctcttcttcgtcttcgctgtctaccactatctctggggaagggcttctccgctctgcggcggtgcgcttcttttttttcttgggagcagccgtgacggagtccgccacggcgacggaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcctctcgagctggtcttggtctcgactggccattgtatcctcctcctcctaggcagagagacataaggagtctatcatgcaagtcgagaaggaggagagcttaaccaccccctctgacaccgccgatgcgcccgccgtcgccgtcgcccccgctgccgccgacgcgcccgccacaccgagcgacacccccgcggacccccccgccgacgcacccctgttcgaggaagcggccgtggagcaggacccgggctttgtctcggcagaggaggatttgcgagaggaggagaataaggagaagaagccctcagtgccaaaagatgataaagagcaagacgagcacgacgcagatgcacaccagggtgaagtcgggcggggggacggagggcatggcggcgccgactacctagacgaagggaacgacgtgctcttgaagcacctgcatcgtcagtgcgccatcgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgccttcgtggtgcccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtgccaaagatctttgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctaaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgcggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgtctggaggagcgcaacctcaaagagctggagaagctcctgcagcgcgcgctcaaagacctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaggaccaatcccgcccgcccaaggcggagctgaccgcctgcgtcatcacccagggcgagatcctaggccaattgcaagccatccaaaaagcccgccaagattttttgctgaagaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcgattaccaccacgccccgcaataatcccaaccccagggagtggcccgcgtccctggtgtatcaggaaattcccggccccaccaccgtactacttccgcgtgattcccaggccgaagtccaaatgactaactcaggggcgcagctcgcgggcggctgtcgtcacagggtgcggccccctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctccggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgagaaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgattttatagaaccccagtgcaatatcacttataaatctgaatataacctctgcactatcctaattaaatgcgttactcaacacgatgaggtaactgttagatacaaagatcaatcaaaaagagacgcactttacagcagctggcaaccaggagatgaacaaaaatacaatgtgaccgtcttccagggcaaactctccaaaacttacaattacactttcccattcgaggagatgtgtgagtttgtcatgttcatgtcaaagcagtacaagatgtggcctccgactccccagggctgtgtggaaaatccaggctctttctgcatgatctctctctgtgtaactgtgctggcactaatactcacgcttttgtatatcagatttaaatcaaggcaaagcttcatcgatgaaaagaaaatgccttaatcgcttttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatttaaccttgattgatgttcaattgctggatgcgggctactattatgggcagctgggtacaatcgttaattactggagaccccacaaagattacatgcttcacgtagtaaagggtccccttagcagcccgaccactaccaccacctctaccacacccactaccaccactactcccatcaccagcactgccacccagcctcctcatagcagaacaaccacttttatcaattccaagtcccactccccccacattgccggcgggccctccgcctcaaactccgagaccaccgagatctgcttctgcaaatgctctgacgccattgcccaggatttggaagaccacgaggaagatgagcatgacttcgcagatgcatgccaggcatcaggggcagaagcactgccggtggccctcaaacagtatgcagactcccataccacccccgatcttccaccgccttcccagaagccaagtttcctgggggaaaatgaaacactgcctctctccatacttgctttgacatctgttgctattctgactgctctgctggtgctcctatgctctatatgctacctgatctgctgcaggaagaaaaaatctcacggccatgctcaccagccgcttatgcacttcccttaccctccagagttgggcgaccacaaactttaagtctgcagtagctatctgcccatcccttgtcagtcgacagcgatgagccccactaatctaacggcctctggacttacaacattgtctcttaatgagaccaccgctcctcaagacctgtacgatggtgtctccgcgctggttaaccagtgggatcacctgggcatatggtggctcctcataggagcagtgaccctgtgcctaatcctggtctggataatctgctgcatcaaaagcagaagacccaggcggcggcccatctacaggcccttcgtcatcacacctgaagatgatgatggcaccacgtccaggctgcagagcctaaagcagctactcttctcttttacagcatggtaaattgaacatgcctcgcattttcatctacttgtttcttcttccactctttttgggctcttctacattggcagctgtgtcccacatcgaggtagactgcatctcgcccttctcagtctacttactcttcggctttgtcatttgcaactttgtctgcagcgttatcactgtagtgatctgcttcatacagtgcatcgactacgtctgcgtacgggtggcctattttagacaccacccccagtatcgcaacagggacatagcggctctcctaagacttgtttaaatcatgcccaaattaactgtgattgctcttctgattatctgctgcgtcctagccgcgattgggactcagcctactaccaccaccaccagcgctcccagaaagagacatgtttcctgcagcttcaaacgtccctggaatataccccaatgctttactgatgaacctgaaatctctttggcttggtacttcagcgtcaccgcccttctcatcttctgcagtacggttattgcccttgccatttacccttcccttgacctgggctggaatgctgtcaactctatggaatatcccaccttcccagaaccagacctgccagacctggttgttctaaacgcgtttcctcctcctcccgttcaaaatcagtttcgccctccgtccccgacgcccactgaggtcagctactttaatctaacaggcggagatgactgaaaacctagacctagaaatggacggcctctgcagcgaacaacgcatactagagaggcgccggcaaaaagcagagctcgagcgtcttaaacaagagctccaagacgcggtggccatacaccagtgcaaaaaaggtgtcttctgtctagtgaaacaggccacgctcacctatgaaaaaacaggtgacacccaccgcctaggatacaagctgcccacacaacgccagaagttcgcccttatgataggcgaacaacccatcaccgtcacccagcactctgtggagacagaaggctgcatacacgctccctgcaggggcgctgactgtctctacaccttgatcaaaaccctctgcggccttagagacctcatccctttcaattgatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtcccttttcccacccctccctttgtgtcccccgcaggaatgcaagaaaacccccctggagtgctatccctacgccttgcagaacccttgaccacctccaatggagcgctgaccctaaaaatggggggtggtttgaccctggacgaagaaggaaagcttacttcccaaaatattaccagtgttgatcctcctcttaaaaaaacaaaaaacaatatcagtctgcagactgcctccccccttgccgtcagctcgggagccctcacacttttcgctactcctcccctggcagttaatgacaataacctaactgtgcagtctcaggctccccttacactggaaaactcaaaactaagtctggccaccaaaggccccctaaccgtttctgaaggaaaacttgccctagaaacagaggctcccttgcatgcaagcgacagcagtagcctaggccttagtgtaacggccccactgagcattagcagcgacagcctaggactagacttgcaagcgcccattatttctgaaaatggaaaactgggcctaagagtaacaggtcccctaactgtggccagcagtattgatgctttgacagtagccacaggcagcggtattggacttgatagcaacacgcgcctacaggcaaaattggtcgcgcccctaggctttgacaccaatggcaacattaagctcagcacttcgggcggcatgagactgaacaatggcacacttatactagatgtaaactacccatttgaggctcaaggtcaacttagtctaagagtgggttcgggtccactgtatgtagactccaacacacataacctaaccgctagatgccttagagggctatacataacgtcatctaataaccaaaccggcctggaggccaacataaaacttacaaaaggacttgtgtttgatggaaatgccatagcagttaatgttagcaaagggctagaatacagtaccactgaaacagcgcagggtgtaaatcccatacagactaaaataggtttgggcatggaatatgataccaatggagccataaagccaagactaggctctggtttgagctttgataattcaggagctattgtagtgggaaacaaaaatgatgacactcttactctgtggactacaccagacccatctcccaactgtcagattaactcggaaaaagatgctaaactaaccttggtactaaccaagtgcggtagtcaaattgtaggcacagtatctgcctttgctcttaaaggcagccttgccccaattaatggcacagtgagctcagttagtatattcctaagatttaatgaaaatggggtactgatgagcaactcatcgttggaaagccaatactggaattacaggaatggaaattcaactaatgccacaccatatacaaatgcactaggttttatgcctaacctggcagcttatcccaaaggccaggcaacgactgcaaaaagcagcatcattagccaggtttacatgaatggtgacacttccaaacctatgatatttacaataacttttaatgggcttgaaacagaggaaactcaggtcagtacatattccatgacattttcatggaggtggacaaatggagactacgtggggcactattttaaaacaaactcctttactttctcctacattgcccaagaataaagaaagcacagagatgcttgtttttgatttcaaaattgtgtgcttttatttatttcaagcttacagtatttccagtagtcattcgaatagagcttaattaaactgcatgagaacccttccacatagcttaaattagcaccagtgcaaatggagaaaaatcaacatacctttttatccagatatcagagaactctagtggtcagttttcccccaccctcccagctcacagaatacacagtcctttccccccggctggctttaaacaacactatctcattggtaacagacatattcttaggtgtaataatccacacggtctcttggcgggccaaacgctggtcggtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgcagcaacaaggcgcgcagcaactcctgccgccgcctctccgtacggcaggaatgcaacggcgtggtggtctcctccgcgataatccgcaccgctcgcagcatcagcatcctcgtcctccgggcacagcagcgcatcctgatctcactgagatcggcgcagtaagtgcagcacaaaaccaagatgttatttaagatcccacagtgcaaagcgctgtacccaaagctcatggcgggaaggacagcccccacgtgaccatcataccagatcctcaggtaaatcaaatgacgacctctcataaacacgctggacatgtacatcacctccttgggcatgtgctgattcaccacctctcgataccacaagcatcgctgattaattaaagacccctcgagcaccatcctgaaccaggaagccagcacctgaccccccgccaggcactgcagggaccccggtgaatcgcagtggcagtgaagactccagcgctcgtagccgtgaaccatagagctggtcattatatccaaattggcacaacacagacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgttcggtgtagtagttgtaatacagccactccctgagaccgtcaaggcgctccctggcgtccggatctatgacaacaccgtcctgcagcgccgccctgatgacatccaccaccgtagagtatgccaagcccagccaggaaatgcattcactttgacagcgagagataggaggagcggggagagatggaagaaccatgatagtaaagagaacttttattccaatcgatcttctaagatatcaaagtggagatctataagatgacactggtctcctccgctgagtcgatcaaaaataacagctaaaccacaaacaacacgattggtcaaatgctccacaagggcctgcagcataaaattgcctcggaactccaccgcaagcataacatcaaagccaccgcctctatcgtgatcaagaataaaaaccccacagctatccaccagacccatatagttttcatctctccatcgtgaaaaaagatttacaagctcctcctttaaatcacctccaaccaattgaaaaagttgaaccagaccgccctccaccttcattttcagcaagcgtatcatgattgcaaaaattcaggctcctcagacacctgtataagattgagaagcggaacgttaacatcgatgtttcgctcgcgtaaatcacgcctcagtgcaagcataatataatcccacaggtcggagcggatcagcgaggacacctccccgccaggaaccaactcaacggagcctatgctgattataatacgcatattcggagctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacgaccacagaaaaatgcacaatttttctctcaaacatgactgcgagccctgcaaaaaataaaaaagaaacattacacaagagtagcctgtcttacgatgggatagactactctaaccaacataagacgggccacaacatcgcccgcgtggccataaaaaaaattgtccgtgtgattaaaaagaagcacagatagctggccagtcatatccggagtcatcacgtgtgaacccgtgtagacccccgggttggacacatcggccaaagaaagaaagcggccaatgtacccaggaggaattataacactaagacgaagatacaacagaataaccccatgagggggaataacaaagttagtaggtgaataaaaacgataaacacccgaaactccctcctgcgtaggcaaaatagcaccctccccttccaaaacaacatatagcgcttccacagcagccatgacaaaagactcaaaacactcaaaagactcagtcttaccaggaaaataaaagcactctcacagcaccagcactaatcagagtgtgaaaagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccgctttctcacgatacgtcacttccgcaagaaaagcaaaactacatttcccacatgtgtaaaaacgaaaccccgccccttctaaccgcccacaacttacatcatcaaaacgtaaagtcctacgtcacccgccccgcctctccccgcccacctcattatcatattggccacaatccaaaataaggtatattattgatgatg

SEQ ID NO: 14 - DNA, 37074 bp, Gorilla beringei graueri
catcatcaataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcaccgtcatttgacgcggagggtatttaaacccgctgcgctcctcaagaggccactcttgagtgccagcgagaagagttttctcctctgctccgcttcggtgatcgaaaaatgagacacatagcctgcactccgggtcttttgtccggtcgggcggcggccgagcttttggacgctttgatcaatgatgtcctgagcgatgattttccgtctactacccactttagcccacctactcttcacgaactgtacgatctggatgtactggtggatgtgaacgatcccaacgaggaggcggtttctgcgttttttcccgagtctgcgctgttggccgctcaggagggatttgacctacacactccgccgcctattttagagtctccgctgccggagcccagtggtataccttatatgcctgaactgcttcccgaagtggtagacctgacctgccacgagcctggctttccgcccagcgacgatgatggtgagccttttgttttagactttgctgagatacctgggcacggttgcaggtcttgtgcatatcatcagagggttaccggagaccccgaggttaagtgttcgctgtgctatatgaggatgacctcttcctttatctacagtaagtttttgtctaggtgggcttttgggtaggtgggttttgtgtcagaacaggtgtaaacgttgcttgtgttttttgtacctgtaggtccggtgtccgagccagacccggagcccgaccgcgatcccgagccggatcccgagcctcctcgcaggacaaggaaactaccttccattctgtgcaagtctcagacacctgtaaggaccagcgaggcagacagcaccgactctggcacttctacctctccccctgaaattcacccagtggttcctctgggtatacataaacctgttgctgttagagtttgcgggcgacgccctgcagtacagtgcattgaggacttgcttcacgatcccgaggaacctttggacttgagccttaaacgccctaggcaataaaccccacctaagtaataaaccccacctaagtaataaaccctgccgcccttggttattgagatgacgcccaatgtttgcttttgaatgacttcatgtgtgtaataaaagtgagtgtgatcataggtctcttgtttgtctgggcggggcttaagggtatataagtttctcggggctaaacttggttacacttgaccccaatggaggcgtgggggtgcttggaggagtttgcggacgtgcgccgtttgctggacgagagctctaaccatacctatactatttggaggtatctgtggggctctactcaggccaagttggtctccagaattaagcaggattacaagtgcgattttgaagagctttttagttcctgcggtgagcttttgcaatccttgaatctgggccatcaggctattttccaggaaaaggttctctcgactttggatttttccactcccgggcgcaccgccgcttgtgtggcttttgtgtcttttgtgcaagataaatggagcgaggagacccacctgagtcacggctacgtactggatttcatggcgatggctctttggagggctcacaacaaatggaagattcagaaggaactgtacggttccgccctacgtcgtccacttttgtcgcgacaggggctgaggtttcccgaccatcggcagcatcagaatctggaagacgagtcggaggagcgagcggaggagaagatcagcttgagagccggcctggaccctcctcaggaggaatgaatctcccgcaggtggttgacctgtttccagaactgagacgggtcctgactatcagggaggatggtcagtttgtgaagaagtttaagagggatcggggtgagggagatgatgaggcggctagcaatttagcttttagtctgatgactcgccaccgaccggaatgtattacctatcagcagattaaggagagttgtgccaacgagctggatcttttgggtcagaagtatagcatagaacagcttaccacttactggcttcagcctggggatgattgggaagaggcgatcagggtgtatgcaaaggtggccctgcggcccgattgcaagtataagattactaagttggttaatattagaaactgctgctatatttctgggaacggggccgaagtggagatagatactcaggacagggtggcttttaggtgttgcatgataaacatgtggcccgggatactggggatggatggggtggtgttcatgaatgtgaggtttacgggccccaactttaatggcacggtgttcatgggcaacaccaacttgctcctgcatggtgcgagtttctatgggtttaataacacctgtatagaggcctggaccgatgtaaaggttcgaggttgttccttttatagctgttggaaggcggtggtgtgtcgccctaaaagcaggggttctgtgaaaaaatgcttgtttgaaaggtgcaccttaggcatcctctctgagggcaactccagggtgcgccataatgtggcttcgaactgcggttgcttcatgcaagtgaagggggtgagcgttatcaagcataactcggtgtgtggaaactgcgaggatcgcgcctcccagatgctgacctgctttgatggtaactgtcacctgttgaagaccattcatataagcagccaccccagaaaggcctggcccgtgtttgagcataacatcctgacccgctgctccttgcatctgggggtcaggaggggtatgttcctgccttaccagtgtaactttagccacactaaaatcctgctggaacccgagtgtatgaccaaggtcagcctaaatggcgtgtttgatgcgactctgagaatctggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgtaccagggccgagtttgggtctagcgatgaggataccgattgaggtgggtaaggtgggcgtggctagcagggtggggcgtgtataaattgggggtctaagggtctctctgttttgtcttgcaacagccgccgccatgagcgacaccggcaacagctttgatggaagcatctttagcccctatttgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcagcgcggcctctcgcgcgtctgctcgggatgagaaactgaccgctctgctgcttaaactggaagacttgacccgggagctgggtcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataagacatctttacaaatcgggggcggagggtcccggactggggtatgatggtaccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagcctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcgccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtcctgaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaaggaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacgggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcctcctggagatctcctcgtccggcgcgctccacggtggccgccaggtcgttggagatgcgacccatgagctgcgagaaggcgttgagcccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacgccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcataaggcggtggtatccgtagatgtacctggacatccaggtgatgccggcggcggtggtggtggcgcgcgcgtagtcgcggacccggttccagatgtttcgcaggggcaagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgagggccgtggcagccccgtcctcaggaccccgccagccgacttctccagttacgggagcgagccccttttgtttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtgaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggacgatgaccaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgagtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggatgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttgaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggaaacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacgcaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcattaaccgcctgatggactacttgcatcgggcggcggccgtgaaccccgagtacttcactaatgccattctgaatccccactggatgccccctccgggtttctacaacggggacttcgaggtgcccgaggttaacgacgggttcctctgggatgacatggatgacagtgtgttctcacccaacccgctgcgcgccgcgtctctgcgattgaaggagggttctgacagggaaggaccgaggagtctggcctcctccctggctctgggagcggtgggcgcggcggcgcggggcagtagccccttccccagcctggcagactctctgaacagcgggcgggtgagcaggccccgcttgctaggcgaggaggagtatctgaacaactccctgctgcagcccgcgagggacaaaaacgctcagcggcagcagtttcccaacaatgggatagagagcctggtggacaagatgtccagatggaagacgtatgcgcaggagtacaaggagtgggaggaccgccagccgcggcccctgccgccccctaggcagcgctggcagcggcgcgcgtccaaccgccgctggaggcaggggcccgaggacgatgatgactctgcagatgacagcagcgtgctggacctgggcgggagcgggaaccccttttcgcacctgcgcccccgcctgggcaagatgttttaaaagagaaaaaataaaaactcaccaaggccatggcgacgagcgttggttttttgttcccttccttagtatgcgacgcgcggcgatgttcgaggaggggcctcccccctcttacgagagcgcgatgggattttctcctgcgacgcccctacagcctccctacgtgcctcctcggtacctgcaacctaccgggggaagaaatagcatctgttactctgagctgcagcccctgtatgacaccaccaaagtgtacctggtggacaacaagtctgcggacgtggcctccctgaactaccagaacgaccacagcgattttttgaccaccgtgatccaaaacaatgacttcaccccaaacgaggccagcacccagaccataaacctggacaacaggtcgcactggggcggtgatctgaagaccatcttgcacaccaacatgcccaacgtgaatgagtttatgtttactaactcttttaaggcgcgggtaatggtggcgcgcgacgataagggagtgcctaaatacgagtgggtggactttacactgcccgagggcaactactccgagatcatgactcttgacctgatgaacaacgcgatcgtggagcactacttgaaagtaggcaggcagaacggggtaaaagaaagcgatattggagttaagtttgacaccaggaactttcgcctgggatgggaccccgagacggggttggttatgcccggggtttacactaatgaagcttttcaccccgatatagtgctcttgcccggatgcggggtggacttcacccaaagccggctgagcaacctgctgggcattcgaaagcgccagccattccaggaggggtttcaaatcacttatgagcatttggaagggggcaacattccggcgcttctggatttggtcgcctacgaggagagtttgaaatccgaggaaagcggggataacactgacaagggcggcgaggagcaagccggcgatggcgacactgcttcggtagaaaacgaaagtgcgtccgtggtggaggcggcggcggtagcgaccgcagagccggagaccgtagaggaggatatgaatgatagcgcaatcagaggagactcgtttattccccggggcgaagaaaagaaggcggaggctgcggcagcagtcgaagcagagcccaaagtcgagtcggagatcatggaggaggatttgaatgataacgcgatcagaggtgatacgtttgtgccgcggggcgaagaaaaaaaagcggaggcggaggccgcggctgaggaggcggccgaggctgtggcagccaccgcggcggtgactgaaacaactgaggagcaggttcaggccgagcaggttcaaaagaagcccgtgattaaagccctaacacaagatagcaaggagcgcagttacaacttgattcccggtagtactgacaccgagtaccgcagctggtacctggcatacaactacggcgacccggtcaaaggggtgcgctcgtggactctgctttgcacgccggacgtcacctgcggctccgagcagatgtactggtcgttgccaaacatgatgcaagacccggtgaccttccgctccacgcggcaggttaacaacttcccggtggtgggcgccgaactgctgcccgtgcactccaagagcttttacaacgagcaggccgtgtactcccagctgatccgccaggccacctctctgacccacgtgttcaatcgctttcccgagaaccagattttggcgcgcccgccggcccccaccatcactaccgtcagtgaaaacgttcctgctctcacagatcacgggacgctaccgctgcgcaacagcatctcaggagtccagcgagtgaccattactgacgccagacgccggacctgcccctacgtttacaaggccttgggcatagtctcgccgcgcgtcctctccagccgcactttttaaaacacatattcacccacgcttcaaagattatgtctatacttatctcacccagcaataacaccggctgggggctgcgcgcgcccagcaagatgtttggaggggcgagaaaacgttccgagcagcacccagtgcgcgtgcgcggccactaccgcgcgccctggggagcgcacaagcgcgggcgcgcagggcgcaccactgtggacgacgccattgactccgtagtggagcaggcgcgccactacacacccggcgcgccgtccgcccccgccgtgtccaccgtggacgaggcgatcgaaagcgtggtacagggcgcgcggcactatgccaaccttaaaaatcgccgccgtcgcgtggcccgccgccatcgccggagaccccgggccaccgccgccgcgcgccttgctaaggctctactcaggcgcgccaggcgaactggccgccgggccgccatgagggccgcacggcgggctgccgccagtgcggccgccgcggccccacgggcacgaaggcgcgcggccgctgccgccgccgccgccatttccagcttggcctcaacgcggcgcggtaacatatactgggtgcgcgactcgataaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgatgacgaggcggtggagtttgtccgccgcatggcacccaggcgccccgtgcagtggaagggtcggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtgaccctgcaacaggtgctgcctttgagcgcgcccagcgagcataagcgagggttgaagcgcgagggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcagcggccagcgccaccaccggcaccgcttcggtagaggtgcagacggacccctggctacccgccgccgctgtcgccgccgccgccgccccccgttctcgcgggcgcaagagaaattatccagtggccagcgcgctcatgccccagtacgcactgcatccatccatcgcgcccacccccggctaccgcgggtattcgtaccgcccgcgcagatcggccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcatttttttggaggaaaaaataaaaaagtctagactctcacgctcgcttggtcctgtgactattttgtagaaaaaagatggaagacatcaactttgcgtcgctggccccgcgtcatggctcgcgcccgttcatgggagactggacagatatcggcaccagcagtatgagcggtggcgccttcagctggggcagtctgtggagcggccttaaaaattttggttccaccattaaaaactatggcaacaaagcgtggaacagcagcacgggccagatgctaagagacaagttgaaagagcagaacttccaggagaaggtggcgcagggcctggcctctggcatcagcggggtggtggacatagctaaccaggccgtgcagaaaaagataaacagtcatctggacccccgccctcaggtggaggaaacgcctccagccatggagacggtgtttcccgagggcaaaggcgaaaagcgcccgcggcccgacagggaagagaccctggtgtcacacaccgaggagccgccctcttacgaggaggcactcaaggccggcctgcccaccactcgccccgtagctcccatggccacaggtgtggtgggccataaacaacacacccccgcaacactagatctgcccccgccgtccgagccgccgcgtcagccaaagacggcgacggtgcccgctccctccacttccgccgccaacagagtgtccctgcgccgcactacgggcgcccctcggggaccgcgactgagcggcaactggcagagcacactgaacagcattgtgggcctgggagtgaaaagtgtgaagcgccgccgttgctactgaatgagcaagctagctaacgtgttatatgtgtgtatgcgtcctatgtcgccgccagaggagctgttgagccgcccgcgccgtctgcactccagcgaatttcaagatggcgaccccttcgatgatgccacagtggtcgtacatgcacatctcgggccaggacgcctcggagtacctgagccccgggctggtgcagttcgcccgcgccaccgacagctacttcagcctaagtaacaaatttaggaaccctacggtggcacccacccacgatgtgaccacggaccggtcgcagcgcctgacgctgcggtttatccccgtggatcgggaggacactgcctactcttacaaggcgcgcttcacgctagccgtgggcgacaaccgcgtgctggacatggcctccacctactttgatatccggggtgtgctggacaggggtcccacctttaagccctactcgggcactgcctacaactccctggctcctaaaggcgctcccaattcttgcgagtgggatgaaaaaactaatactgctgaagcagccattgaaaatgaagaagagctggcggatgagccagaagagcaagcagaagaggctataaaaaccaatgtgtttgcccaggcgccatattctggcaatgcaatttccaaagaaggaatacaagtaggcatagaaggcattggagagcaagtaaaagccgtatacgcagacaaaacctaccagccggaacctcaggttggagaaactcaatggaatgagactgaaataaatcatggagcaggaagggtgctgaagaagaccactcccatgaagccttgctatggttcttatgctaaacctactaatgaatatggaggccagggcatccttgtagaaaaaaatggcaaaatggaaagccaggtggaaacacagttttttgctcttgacggtgaaaatgataatagtccaaaagtggtgttgtatagcgaagatgtaaacttggatactcctgacacacacctatcatacaaacctagcgcccaagatgtaaactctaaagaaatgttgggccaacaggccatgcccaacaggccaaatcttattgcttttagggacaactttattggacttatgtactacaacagcactggcaacatgggagtgctggcaggacaggcctcccaactaaatgccgtggtagacttgcaagacagaaacacagagttgtcataccagctgatgcttgattccattggagacagatcaagatattttgccatgtggaaccaggcggttgatagttacgatccagatgttagaattattgaaaaccatggcacagaggatgaacttccaaactactgttttcctttgggaggaatatttaatactcagagttttaaaaaggtaaaacctggaacggataacggatgggaaacagatgatgacttttcagataaaaatgaaataagagttggcaacaactttgccatggagatcaatatccaggcaaacctgtggagaagcttcttgtattccaatgtggctctctacctgccagataagatgaagtactctccaaccaacatagacatttccaccaacactaacacctatgactacatgaacaaaagagtggcgcctccaggcctggtggactgctatgtcaatctgggggccaggtggtcccttgatgtaatggataacatgaacccctttaaccaccaccgcaatgcgggcctgcgataccgttccatgcttctgggtaacggccgctacgtgcccttccacatccaggtgccccaaaagttctttgccatcaaaagccttctactcttgcctggctcgtacacctacgaatggaatttcagaaaggatgtgaacatggtcctacagagctctctgggcaacgaccttagggtggatggggccagcatcaagtttgacagcatcaccctttatgctacctttttccccatggcccacaacaccgcttccacgcttgaggccatgctcagaaacgacaccaacgaccagtccttcaatgactacctctctggggccaacatgctctaccccatccccgccaacgctaccaacgtgcccatctccattccctctcgcaactgggccgccttcagaggctgggcatttacccgccttaagaccaaggagaccccctccctgggctcgggttttgacccctactttgtctactcgggatccatcccctacctggatggcaccttctacctcaaccacacttttaagaagatatccatcatgtatgactcctctgtcagctggccgggcaacgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccgttggcatcactcaccagcacaacaactcgggattcgtgggctacctggcacccaccatgcgcgagggacaggcctaccccgccaacttcccctaccccttgataggcaagaccgcggtcgacagcgtcacccagaaaaagttcctctgcgaccgcaccctctggcgcatccccttttctagcaacttcatgtccatgggcgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacttgctacctctttgacccttttggcttctccgatcagcgcctcaagcagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcgcatccggggggccacctctttctgccacttgcaagaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggttcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattatgcacgctggccagcaggctctcgtcgctgatcatgtcgctgtccagatcctccgcgttgctcagggcgaatggggtcatcttgcagacctgcctgcccaggaaaggcggcagcccgggcttgccgttgcagtcgcagcgcaggggcatcagcaggtgcccgcggcccgactgcgcctgcgggtacagcgcgcgcatgaaggcttcgatctgcctgaaagccacctgcgccttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtcccgtgcagacacttcaggtcgccctccgtctgggtgcagcggtgctcccacagcgcgcaaccggtgggctcccaattcttgtgggtcacccccgcgtaggcctgcaggtaggcctgcaagaagcgccccatcatggccacgaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagcgccgcctgctcttcttcgtcttcgctgtctaccactatctctggggaagggcttctccgctctgcggcggtgcgcttcttttttttcttgggagcagccgtgacggagtccgccacggcgacggaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcctctcgagctggtcttggtctcgactggccattgtatcctcctcctcctaggcagagagacataaggagtctatcatgcaagtcgagaaggaggagagcttaaccaccccctctgacaccgccgatgcgcccgccgtcgccgtcgcccccgctgccgccgacgcgcccgccacaccgagcgacacccccgcggacccccccgccgacgcacccctgttcgaggaagcggccgtggagcaggacccgggctttgtctcggcagaggaggatttgcgagaggaggagaataaggagaagaagccctcagtgccaaaagatgataaagagcaagacgagcacgacgcagatgcacaccagggtgaagtcgggcggggggacggagggcatggcggcgccgactacctagacgaagggaacgacgtgctcttgaagcacctgcatcgtcagtgcgccatcgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgccttcgtggtgcccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtgccaaagatctttgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctaaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgcggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgtctggaggagcgcaacctcaaagagctggagaagctcctgcagcgcgcgctcaaagacctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaggaccaatcccgcccgcccaaggcggagctgaccgcctgcgtcatcacccagggcgagatcctaggccaattgcaagccatccaaaaagcccgccaagattttttgctgaagaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcgattaccaccacgccccgcaataatcccaaccccagggagtggcccgcgtccctggtgtatcaggaaattcccggccccaccaccgtactacttccgcgtgattcccaggccgaagtccaaatgactaactcaggggcgcagctcgcgggcggctgtcgtcacagggtgcggccccctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctccggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgagaaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgattttatagaaccccagtgcaatatcacttataaatctgaatataacctctgcactatcctaattaaatgcgttactcaacacgatgaggtaactgttagatacaaagatcaatcaaaaagagacgcactttacagcagctggcaaccaggagatgaacaaaaatacaatgtgaccgtcttccagggcaaactctccaaaacttacaattacactttcccattcgaggagatgtgtgagtttgtcatgttcatgtcaaagcagtacaagatgtggcctccgactccccagggctgtgtggaaaatccaggctctttctgcatgatctctctctgtgtaactgtgctggcactaatactcacgcttttgtatatcagatttaaatcaaggcaaagcttcatcgatgaaaagaaaatgccttaatcgcttttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatttaaccttgattgatgttcaattgctggatgcgggctactattatgggcagctgggtacaatcgttaattactggagaccccacaaagattacatgcttcacgtagtaaagggtccccttagcagcccgaccactaccaccacctctaccacacccactaccaccactactcccatcaccagcactgccacccagcctcctcatagcagaacaaccacttttatcaattccaagtcccactccccccacattgccggcgggccctccgcctcaaactccgagaccaccgagatctgcttctgcaaatgctctgacgccattgcccaggatttggaagaccacgaggaagatgagcatgacttcgcagatgcatgccaggcatcaggggcagaagcactgccggtggccctcaaacagtatgcagactcccataccacccccgatcttccaccgccttcccagaagccaagtttcctgggggaaaatgaaacactgcctctctccatacttgctttgacatctgttgctattctgactgctctgctggtgctcctatgctctatatgctacctgatctgctgcaggaagaaaaaatctcacggccatgctcaccagccgcttatgcacttcccttaccctccagagttgggcgaccacaaactttaagtctgcagtagctatctgcccatcccttgtcagtcgacagcgatgagccccactaatctaacggcctctggacttacaacattgtctcttaatgagaccaccgctcctcaagacctgtacgatggtgtctccgcgctggttaaccagtgggatcacctgggcatatggtggctcctcataggagcagtgaccctgtgcctaatcctggtctggataatctgctgcatcaaaagcagaagacccaggcggcggcccatctacaggcccttcgtcatcacacctgaagatgatgatggcaccacgtccaggctgcagagcctaaagcagctactcttctcttttacagcatggtaaattgaacatgcctcgcattttcatctacttgtttcttcttccactctttttgggctcttctacattggcagctgtgtcccacatcgaggtagactgcatctcgcccttctcagtctacttactcttcggctttgtcatttgcaactttgtctgcagcgttatcactgtagtgatctgcttcatacagtgcatcgactacgtctgcgtacgggtggcctattttagacaccacccccagtatcgcaacagggacatagcggctctcctaagacttgtttaaatcatgcccaaattaactgtgattgctcttctgattatctgctgcgtcctagccgcgattgggactcagcctactaccaccaccaccagcgctcccagaaagagacatgtttcctgcagcttcaaacgtccctggaatataccccaatgctttactgatgaacctgaaatctctttggcttggtacttcagcgtcaccgcccttctcatcttctgcagtacggttattgcccttgccatttacccttcccttgacctgggctggaatgctgtcaactctatggaatatcccaccttcccagaaccagacctgccagacctggttgttctaaacgcgtttcctcctcctcccgttcaaaatcagtttcgccctccgtccccgacgcccactgaggtcagctactttaatctaacaggcggagatgactgaaaacctagacctagaaatggacggcctctgcagcgaacaacgcatactagagaggcgccggcaaaaagcagagctcgagcgtcttaaacaagagctccaagacgcggtggccatacaccagtgcaaaaaaggtgtcttctgtctagtgaaacaggccacgctcacctatgaaaaaacaggtgacacccaccgcctaggatacaagctgcccacacaacgccagaagttcgcccttatgataggcgaacaacccatcaccgtcacccagcactctgtggagacagaaggctgcatacacgctccctgcaggggcgctgactgtctctacaccttgatcaaaaccctctgcggccttagagacctcatccctttcaattgatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtcccttttcccacccctccctttgtgtcccccgcaggaatgcaagaaaacccccctggagtgctatccctacgccttgcagaacccttgaccacctccaatggagcgctgaccctaaaaatggggggtggtttgaccctggacgaagaaggaaagcttacttcccaaaatattaccagtgttgatcctcctcttaaaaaaacaaaaaacaatatcagtctgcagactgcctccccccttgccgtcagctcgggagccctcacacttttcgctactcctcccctggcagttaatgacaataacctaactgtgcagtctcaggctccccttacactggaaaactcaaaactaagtctggccaccaaaggccccctaaccgtttctgaaggaaaacttgccctagaaacagaggctcccttgcatgcaagcgacagcagtagcctaggccttagtgtaacggccccactgagcattagcagcgacagcctaggactagacttgcaagcgcccattatttctgaaaatggaaaactgggcctaagagtaacaggtcccctaactgtggccagcagtattgatgctttgacagtagccacaggcagcggtattggacttgatagcaacacgcgcctacaggcaaaattggtcgcgcccctaggctttgacaccaatggcaacattaagctcagcacttcgggcggcatgagactgaacaatggcacacttatactagatgtaaactacccatttgaggctcaaggtcaacttagtctaagagtgggttcgggtccactgtatgtagactccaacacacataacctaaccgctagatgccttagagggctatacataacgtcatctaataaccaaaccggcctggaggccaacataaaacttacaaaaggacttgtgtttgatggaaatgccatagcagttaatgttagcaaagggctagaatacagtaccactgaaacagcgcagggtgtaaatcccatacagactaaaataggtttgggcatggaatatgataccaatggagccataaagccaagactaggctctggtttgagctttgataattcaggagctattgtagtgggaaacaaaaatgatgacactcttactctgtggactacaccagacccatctcccaactgtcagattaactcggaaaaagatgctaaactaaccttggtactaaccaagtgcggtagtcaaattgtaggcacagtatctgcctttgctcttaaaggcagccttgccccaattaatggcacagtgagctcagttagtatattcctaagatttaatgaaaatggggtactgatgagcaactcatcgttggaaagccaatactggaattacaggaatggaaattcaactaatgccacaccatatacaaatgcactaggttttatgcctaacctggcagcttatcccaaaggccaggcaacgactgcaaaaagcagcatcattagccaggtttacatgaatggtgacacttccaaacctatgatatttacaataacttttaatgggcttgaaacagaggaaactcaggtcagtacatattccatgacattttcatggaggtggacaaatggagactacgtggggcactattttaaaacaaactcctttactttctcctacattgcccaagaataaagaaagcacagagatgcttgtttttgatttcaaaattgtgtgcttttatttatttcaagcttacagtatttccagtagtcattcgaatagagcttaattaaactgcatgagaacccttccacatagcttaaattagcaccagtgcaaatggagaaaaatcaacatacctttttatccagatatcagagaactctagtggtcagttttcccccaccctcccagctcacagaatacacagtcctttccccccggctggctttaaacaacactatctcattggtaacagacatattcttaggtgtaataatccacacggtctcttggcgggccaaacgctggtcggtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgcagcaacaaggcgcgcagcaactcctgccgccgcctctccgtacggcaggaatgcaacggcgtggtggtctcctccgcgataatccgcaccgctcgcagcatcagcatcctcgtcctccgggcacagcagcgcatcctgatctcactgagatcggcgcagtaagtgcagcacaaaaccaagatgttatttaagatcccacagtgcaaagcgctgtacccaaagctcatggcgggaaggacagcccccacgtgaccatcataccagatcctcaggtaaatcaaatgacgacctctcataaacacgctggacatgtacatcacctccttgggcatgtgctgattcaccacctctcgataccacaagcatcgctgattaattaaagacccctcgagcaccatcctgaaccaggaagccagcacctgaccccccgccaggcactgcagggaccccggtgaatcgcagtggcagtgaagactccagcgctcgtagccgtgaaccatagagctggtcattatatccaaattggcacaacacagacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgttcggtgtagtagttgtaatacagccactccctgagaccgtcaaggcgctccctggcgtccggatctatgacaacaccgtcctgcagcgccgccctgatgacatccaccaccgtagagtatgccaagcccagccaggaaatgcattcactttgacagcgagagataggaggagcggggagagatggaagaaccatgatagtaaagagaacttttattccaatcgatcttctaagatatcaaagtggagatctataagatgacactggtctcctccgctgagtcgatcaaaaataacagctaaaccacaaacaacacgattggtcaaatgctccacaagggcctgcagcataaaattgcctcggaactccaccgcaagcataacatcaaagccaccgcctctatcgtgatcaagaataaaaaccccacagctatccaccagacccatatagttttcatctctccatcgtgaaaaaagatttacaagctcctcctttaaatcacctccaaccaattgaaaaagttgaaccagaccgccctccaccttcattttcagcaagcgtatcatgattgcaaaaattcaggctcctcagacacctgtataagattgagaagcggaacgttaacatcgatgtttcgctcgcgtaaatcacgcctcagtgcaagcataatataatcccacaggtcggagcggatcagcgaggacacctccccgccaggaaccaactcaacggagcctatgctgattataatacgcatattcggagctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacgaccacagaaaaatgcacaatttttctctcaaacatgactgcgagccctgcaaaaaataaaaaagaaacattacacaagagtagcctgtcttacgatgggatagactactctaaccaacataagacgggccacaacatcgcccgcgtggccataaaaaaaattgtccgtgtgattaaaaagaagcacagatagctggccagtcatatccggagtcatcacgtgtgaacccgtgtagacccccgggttggacacatcggccaaagaaagaaagcggccaatgtacccaggaggaattataacactaagacgaagatacaacagaataaccccatgagggggaataacaaagttagtaggtgaataaaaacgataaacacccgaaactccctcctgcgtaggcaaaatagcaccctccccttccaaaacaacatatagcgcttccacagcagccatgacaaaagactcaaaacactcaaaagactcagtcttaccaggaaaataaaagcactctcacagcaccagcactaatcagagtgtgaaaagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccgctttctcacgatacgtcacttccgcaagaaaagcaaaactacatttcccacatgtgtaaaaacgaaaccccgccccttctaaccgcccacaacttacatcatcaaaacgtaaagtcctacgtcacccgccccgcctctccccgcccacctcattatcatattggccacaatccaaaataaggtatattattgatgatg

SEQ ID NO: 15 - DNA, 37073 bp, Gorilla beringei graueri
catcatcaataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcaccgtcatttgacgcggagggtatttaaacccgctgcgctcctcaagaggccactcttgagtgccagcgagaagagttttctcctctgctccgcttcggtgatcgaaaaatgagacacatagcctgcactccgggtcttttgtccggtcgggcggcggccgagcttttggacgctttgatcaatgatgtcctgagcgatgattttccgtctactacccactttagcccacctactcttcacgaactgtacgatctggatgtactggtggatgtgaacgatcccaacgaggaggcggtttctgcgttttttcccgagtctgcgctgttggccgctcaggagggatttgacctacacactccgccgcctattttagagtctccgctgccggagcccagtggtataccttatatgcctgaactgcttcccgaagtggtagacctgacctgccacgagcctggctttccgcccagcgacgatgatggtgagccttttgttttagactttgctgagatacctgggcacggttgcaggtcttgtgcatatcatcagagggttaccggagaccccgaggttaagtgttcgctgtgctatatgaggatgacctcttcctttatctacagtaagtttttgtctaggtgggcttttgggtaggtgggttttgtgtcagaacaggtgtaaacgttgcttgtgttttttgtacctgtaggtccggtgtccgagccagacccggagcccgaccgcgatcccgagccggatcccgagcctcctcgcaggacaaggaaactaccttccattctgtgcaagtctcagacacctgtaaggaccagcgaggcagacagcaccgactctggcacttctacctctccccctgaaattcacccagtggttcctctgggtatacataaacctgttgctgttagagtttgcgggcgacgccctgcagtacagtgcattgaggacttgcttcacgatcccgaggaacctttggacttgagccttaaacgccctaggcaataaaccccacctaagtaataaaccccacctaagtaataaaccctgccgcccttggttattgagatgacgcccaatgtttgcttttgaatgacttcatgtgtgtaataaaagtgagtgtgatcataggtctcttgtttgtctgggcggggcttaagggtatataagtttctcggggctaaacttggttacacttgaccccaatggaggcgtgggggtgcttggaggagtttgcggacgtgcgccgtttgctggacgagagctctaaccatacctatactatttggaggtatctgtggggctctactcaggccaagttggtctccagaattaagcaggattacaagtgcgattttgaagagctttttagttcctgcggtgagcttttgcaatccttgaatctgggccatcaggctattttccaggaaaaggttctctcgactttggatttttccactcccgggcgcaccgccgcttgtgtggcttttgtgtcttttgtgcaagataaatggagcgaggagacccacctgagtcacggctacgtactggatttcatggcgatggctctttggagggctcacaacaaatggaagattcagaaggaactgtacggttccgccctacgtcgtccacttttgtcgcgacaggggctgaggtttcccgaccatcggcagcatcagaatctggaagacgagtcggaggagcgagcggaggagaagatcagcttgagagccggcctggaccctcctcaggaggaatgaatctcccgcaggtggttgacctgtttccagaactgagacgggtcctgactatcagggaggatggtcagtttgtgaagaagtttaagagggatcggggtgagggagatgatgaggcggctagcaatttagcttttagtctgatgactcgccaccgaccggaatgtattacctatcagcagattaaggagagttgtgccaacgagctggatcttttgggtcagaagtatagcatagaacagcttaccacttactggcttcagcctggggatgattgggaagaggcgatcagggtgtatgcaaaggtggccctgcggcccgattgcaagtataagattactaagttggttaatattagaaactgctgctatatttctgggaacggggccgaagtggagatagatactcaggacagggtggcttttaggtgttgcatgataaacatgtggcccgggatactggggatggatggggtggtgttcatgaatgtgaggtttacgggccccaactttaatggcacggtgttcatgggcaacaccaacttgctcctgcatggtgcgagtttctatgggtttaataacacctgtatagaggcctggaccgatgtaaaggttcgaggttgttccttttatagctgttggaaggcggtggtgtgtcgccctaaaagcaggggttctgtgaaaaaatgcttgtttgaaaggtgcaccttaggcatcctctctgagggcaactccagggtgcgccataatgtggcttcgaactgcggttgcttcatgcaagtgaagggggtgagcgttatcaagcataactcggtgtgtggaaactgcgaggatcgcgcctcccagatgctgacctgctttgatggtaactgtcacctgttgaagaccattcatataagcagccaccccagaaaggcctggcccgtgtttgagcataacatcctgacccgctgctccttgcatctgggggtcaggaggggtatgttcctgccttaccagtgtaactttagccacactaaaatcctgctggaacccgagtgtatgaccaaggtcagcctaaatggcgtgtttgatgcgactctgagaatctggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgcaccagggccgagtttgggtctagcgatgaggataccgattgaggtgggtaaggtgggcgtggctagaagggtggggcgtgtataaattgggggtctaagggtctctctgttttgtcttgcaacagccgccgccatgagcgacaccggcaacagctttgatggaagcatctttagcccctatctgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcagcgcggcctctcgcgcgtctgctcgggatgagaaactgaccgctctgctgcttaaactggaagacttgacccgggagctgggtcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataagacatctttacaaatcgggggcggagggtcccggactggggtatgatggtaccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagcctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcgccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtcctgaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaaggaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacgggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcctcctggagatctcctcgtccggcgcgctccacggtggccgccaggtcgttggagatgcgacccatgagctgcgagaaggcgttgagcccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacgccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcataaggcggtggtatccgtagatgtacctggacatccaggtgatgccggcggcggtggtggtggcgcgcgcgtagtcgcggacccggttccagatgtttcgcaggggcaagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgagggccgtggcagccccgtcctcaggaccccgccagccgacttctccagttacgggagcgagccccttttgtttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtgaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggacgatgaccaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgagtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggatgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttgaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggaaacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacgcaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcattaaccgcctgatggactacttgcatcgggcggcggccgtgaaccccgagtacttcactaatgccattctgaatccccactggatgccccctccgggtttctacaacggggacttcgaggtgcccgaggttaacgacgggttcctctgggatgacatggatgacagtgtgttctcacccaacccgctgcgcgccgcgtctctgcgattgaaggagggttctgacagggaaggaccgaggagtctggcctcctccctggctctgggagcggtgggcgcggcggcgcggggcagtagccccttccccagcctggcagactctctgaacagcgggcgggtgagcaggccccgcttgctaggcgaggaggagtatctgaacaactccctgctgcagcccgcgagggacaaaaacgctcagcggcagcagtttcccaacaatgggatagagagcctggtggacaagatgtccagatggaagacgtatgcgcaggagtacaaggagtgggaggaccgccagccgcggcccctgccgccccctaggcagcgctggcagcggcgcgcgtccaaccgccgctggaggcaggggcccgaggacgatgatgactctgcagatgacagcagcgtgctggacctgggcgggagcgggaaccccttttcgcacctgcgcccccgcctgggcaagatgttttaaaagagaaaaaataaaaactcaccaaggccatggcgacgagcgttggttttttgttcccttccttagtatgcgacgcgcggcgatgttcgaggaggggcctcccccctcttacgagagcgcgatgggattttctcctgcgacgcccctacagcctccctacgtgcctcctcggtacctgcaacctaccgggggaagaaatagcatctgttactctgagctgcagcccctgtatgacaccaccaaagtgtacctggtggacaacaagtctgcggacgtggcctccctgaactaccagaacgaccacagcgattttttgaccaccgtgatccaaaacaatgacttcaccccaaacgaggccagcacccagaccataaacctggacaacaggtcgcactggggcggtgatctgaagaccatcttgcacaccaacatgcccaacgtgaatgagtttatgtttactaactcttttaaggcgcgggtaatggtggcgcgcgacgataagggagtgcctaaatacgagtgggtggactttacactgcccgagggcaactactccgagatcatgactcttgacctgatgaacaacgcgatcgtggagcactacttgaaagtaggcaggcagaacggggtaaaagaaagcgatattggagttaagtttgacaccaggaactttcgcctgggatgggaccccgagacggggttggttatgcccggggtttacactaatgaagcttttcaccccgatatagtgctcttgcccggatgcggggtggacttcacccaaagccggctgagcaacctgctgggcattcgaaagcgccagccattccaggaggggtttcaaatcacttatgagcatttggaagggggcaacattccggcgcttctggatttggtcgcctacgaggagagtttgaaatccgaggaaagcggggataacactgacaagggcggcgaggagcaagccggcgatggcgacactgcttcggtagaaaacgaaagtgcgtccgtggtggaggcggcggcggtagcgaccgcagagccggagaccgtagaggaggatatgaatgatagcgcaatcagaggagactcgtttattccccggggcgaagaaaagaaggcggaggctgcggcagcagtcgaagcagagcccaaagtcgagtcggagatcatggaggaggatttgaatgataacgcgatcagaggtgatacgtttgtgccgcggggcgaagaaaaaaaagcggaggcggaggccgcggctgaggaggcggccgaggctgtggcagccaccgcggcggtgactgaaacaactgaggagcaggttcaggccgagcaggttcaaaagaagcccgtgattaaagccctaacacaagatagcaaggagcgcagttacaacttgattcccggtagtactgacaccgagtaccgcagctggtacctggcatacaactacggcgacccggtcaaaggggtgcgctcgtggactctgctttgcacgccggacgtcacctgcggctccgagcagatgtactggtcgttgccaaacatgatgcaagacccggtgaccttccgctccacgcggcaggttaacaacttcccggtggtgggcgccgaactgctgcccgtgcactccaagagcttttacaacgagcaggccgtgtactcccagctgatccgccaggccacctctctgacccacgtgttcaatcgctttcccgagaaccagattttggcgcgcccgccggcccccaccatcactaccgtcagtgaaaacgttcctgctctcacagatcacgggacgctaccgctgcgcaacagcatctcaggagtccagcgagtgaccattactgacgccagacgccggacctgcccctacgtttacaaggccttgggcatagtctcgccgcgcgtcctctccagccgcactttttaaaacacatattcacccacgcttcaaagattatgtctatacttatctcacccagcaataacaccggctgggggctgcgcgcgcccagcaagatgtttggaggggcgagaaaacgttccgagcagcacccagtgcgcgtgcgcggccactaccgcgcgccctggggagcgcacaagcgcgggcgcgcagggcgcaccactgtggacgacgccattgactccgtagtggagcaggcgcgccactacacacccggcgcgccgtccgcccccgccgtgtccaccgtggacgaggcgatcgaaagcgtggtacagggcgcgcggcactatgccaaccttaaaaatcgccgccgtcgcgtggcccgccgccatcgccggagaccccgggccaccgccgccgcgcgccttgctaaggctctactcaggcgcgccaggcgaactggccgccgggccgccatgagggccgcacggcgggctgccgccagtgcggccgccgcggccccacgggcacgaaggcgcgcggccgctgccgccgccgccgccatttccagcttggcctcaacgcggcgcggtaacatatactgggtgcgcgactcgataaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgatgacgaggcggtggagtttgtccgccgcatggcacccaggcgccccgtgcagtggaagggtcggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtgaccctgcaacaggtgctgcctttgagcgcgcccagcgagcataagcgagggttgaagcgcgagggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcagcggccagcgccaccaccggcaccgcttcggtagaggtgcagacggacccctggctacccgccgccgctgtcgccgccgccgccgccccccgttctcgcgggcgcaagagaaattatccagtggccagcgcgctcatgccccagtacgcactgcatccatccatcgcgcccacccccggctaccgcgggtattcgtaccgcccgcgcagatcggccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcatttttttggaggaaaaataaaaaagtctagactctcacgctcgcttggtcctgtgactattttgtagaaaaaagatggaagacatcaactttgcgtcgctggccccgcgtcatggctcgcgcccgttcatgggagactggacagatatcggcaccagcagtatgagcggtggcgccttcagctggggcagtctgtggagcggccttaaaaattttggttccaccattaaaaactatggcaacaaagcgtggaacagcagcacgggccagatgctaagagacaagttgaaagagcagaacttccaggagaaggtggcgcagggcctggcctctggcatcagcggggtggtggacatagctaaccaggccgtgcagaaaaagataaacagtcatctggacccccgccctcaggtggaggaaacgcctccagccatggagacggtgtttcccgagggcaaaggcgaaaagcgcccgcggcccgacagggaagagaccctggtgtcacacaccgaggagccgccctcttacgaggaggcactcaaggccggcctgcccaccactcgccccgtagctcccatggccacaggtgtggtgggccataaacaacacacccccgcaacactagatctgcccccgccgtccgagccgccgcgtcagccaaagacggcgacggtgcccgctccctccacttccgccgccaacagagtgtccctgcgccgcactacgggcgcccctcggggaccgcgactgagcggcaactggcagagcacactgaacagcattgtgggcctgggagtgaaaagtgtgaagcgccgccgttgctactgaatgagcaagctagctaacgtgttatatgtgtgtatgcgtcctatgtcgccgccagaggagctgttgagccgcccgcgccgtctgcactccagcgaatttcaagatggcgaccccttcgatgatgccacagtggtcgtacatgcacatctcgggccaggacgcctcggagtacctgagccccgggctggtgcagttcgcccgcgccaccgacagctacttcagcctaagtaacaaatttaggaaccctacggtggcacccacccacgatgtgaccacggaccggtcgcagcgcctgacgctgcggtttatccccgtggatcgggaggacactgcctactcttacaaggcgcgcttcacgctagccgtgggcgacaaccgcgtgctggacatggcctccacctactttgatatccggggtgtgctggacaggggtcccacctttaagccctactcgggcactgcctacaactccctggctcctaaaggcgctcccaattcttgcgagtgggatgaaaaaactaatactgctgaagcagccattgaaaatgaagaagagctggcggatgagccagaagagcaagcagaagaggctataaaaaccaatgtgtttgcccaggcgccatattctggcaatgcaatttccaaagaaggaatacaagtaggcatagaaggcattggagagcaagtaaaagccgtatacgcagacaaaacctaccagccggaacctcaggttggagaaactcaatggaatgagactgaaataaatcatggagcaggaagggtgctgaagaagaccactcccatgaagccttgctatggttcttatgctaaacctactaatgaatatggaggccagggcatccttgtagaaaaaaatggcaaaatggaaagccaggtggaaacacagttttttgctcttgacggtgaaaatgataatagtccaaaagtggtgttgtatagcgaagatgtaaacttggatactcctgacacacacctatcatacaaacctagcgcccaagatgtaaactctaaagaaatgttgggccaacaggccatgcccaacaggccaaatcttattgcttttagggacaactttattggacttatgtactacaacagcactggcaacatgggagtgctggcaggacaggcctcccaactaaatgccgtggtagacttgcaagacagaaacacagagttgtcataccagctgatgcttgattccattggagacagatcaagatattttgccatgtggaaccaggcggttgatagttacgatccagatgttagaattattgaaaaccatggcacagaggatgaacttccaaactactgttttcctttgggaggaatatttaatactcagagttttaaaaaggtaaaacctggaacggataacggatgggaaacagatgatgacttttcagataaaaatgaaataagagttggcaacaactttgccatggagatcaatatccaggcaaacctgtggagaagcttcttgtattccaatgtggctctctacctgccagataagatgaagtactctccaaccaacatagacatttccaccaacactaacacctatgactacatgaacaaaagagtggcgcctccaggcctggtggactgctatgtcaatctgggggccaggtggtcccttgatgtaatggataacatgaacccctttaaccaccaccgcaatgcgggcctgcgataccgttccatgcttctgggtaacggccgctacgtgcccttccacatccaggtgccccaaaagttctttgccatcaaaagccttctactcttgcctggctcgtacacctacgaatggaatttcagaaaggatgtgaacatggtcctacagagctctctgggcaacgaccttagggtggatggggccagcatcaagtttgacagcatcaccctttatgctacctttttccccatggcccacaacaccgcttccacgcttgaggccatgctcagaaacgacaccaacgaccagtccttcaatgactacctctctggggccaacatgctctaccccatccccgccaacgctaccaacgtgcccatctccattccctctcgcaactgggccgccttcagaggctgggcatttacccgccttaagaccaaggagaccccctccctgggctcgggttttgacccctactttgtctactcgggatccatcccctacctggatggcaccttctacctcaaccacacttttaagaagatatccatcatgtatgactcctctgtcagctggccgggcaacgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccgttggcatcactcaccagcacaacaactcgggattcgtgggctacctggcacccaccatgcgcgagggacaggcctaccccgccaacttcccctaccccttgataggcaagaccgcggtcgacagcgtcacccagaaaaagttcctctgcgaccgcaccctctggcgcatccccttttctagcaacttcatgtccatgggcgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacttgctacctctttgacccttttggcttctccgatcagcgcctcaagcagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcgcatccggggggccacctctttctgccacttgcaagaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggttcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattatgcacgctggccagcaggctctcgtcgctgatcatgtcgctgtccagatcctccgcgttgctcagggcgaatggggtcatcttgcagacctgcctgcccaggaaaggcggcagcccgggcttgccgttgcagtcgcagcgcaggggcatcagcaggtgcccgcggcccgactgcgcctgcgggtacagcgcgcgcatgaaggcttcgatctgcctgaaagccacctgcgccttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtcccgtgcagacacttcaggtcgccctccgtctgggtgcagcggtgctcccacagcgcgcaaccggtgggctcccaattcttgtgggtcacccccgcgtaggcctgcaggtaggcctgcaagaagcgccccatcatggccacgaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagcgccgcctgctcttcttcgtcttcgctgtctaccactatctctggggaagggcttctccgctctgcggcggtgcgcttcttttttttcttgggagcagccgtgacggagtccgccacggcgacggaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcctctcgagctggtcttggtctcgactggccattgtatcctcctcctcctaggcagagagacataaggagtctatcatgcaagtcgagaaggaggagagcttaaccaccccctctgacaccgccgatgcgcccgccgtcgccgtcgcccccgctgccgccgacgcgcccgccacaccgagcgacacccccgcggacccccccgccgacgcacccctgttcgaggaagcggccgtggagcaggacccgggctttgtctcggcagaggaggatttgcgagaggaggagaataaggagaagaagccctcagtgccaaaagatgataaagagcaagacgagcacgacgcagatgcacaccagggtgaagtcgggcggggggacggagggcatggcggcgccgactacctagacgaagggaacgacgtgctcttgaagcacctgcatcgtcagtgcgccatcgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgccttcgtggtgcccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtgccaaagatctttgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctaaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgcggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgtctggaggagcgcaacctcaaagagctggagaagctcctgcagcgcgcgctcaaagacctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaggaccaatcccgcccgcccaaggcggagctgaccgcctgcgtcatcacccagggcgagatcctaggccaattgcaagccatccaaaaagcccgccaagattttttgctgaagaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcgattaccaccacgccccgcaataatcccaaccccagggagtggcccgcgtccctggtgtatcaggaaattcccggccccaccaccgtactacttccgcgtgattcccaggccgaagtccaaatgactaactcaggggcgcagctcgcgggcggctgtcgtcacagggtgcggccccctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctccggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgagaaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgattttatagaaccccagtgcaatatcacttataaatctgaatataacctctgcactatcctaattaaatgcgttactcaacacgatgaggtaactgttagatacaaagatcaatcaaaaagagacgcactttacagcagctggcaaccaggagatgaacaaaaatacaatgtgaccgtcttccagggcaaactctccaaaacttacaattacactttcccattcgaggagatgtgtgagtttgtcatgttcatgtcaaagcagtacaagatgtggcctccgactccccagggctgtgtggaaaatccaggctctttctgcatgatctctctctgtgtaactgtgctggcactaatactcacgcttttgtatatcagatttaaatcaaggcaaagcttcatcgatgaaaagaaaatgccttaatcgcttttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatttaaccttgattgatgttcaattgctggatgcgggctactattatgggcagctgggtacaatcgttaattactggagaccccacaaagattacatgcttcacgtagtaaagggtccccttagcagcccgaccactaccaccacctctaccacacccactaccaccactactcccatcaccagcactgccacccagcctcctcatagcagaacaaccacttttatcaattccaagtcccactccccccacattgccggcgggccctccgcctcaaactccgagaccaccgagatctgcttctgcaaatgctctgacgccattgcccaggatttggaagaccacgaggaagatgagcatgacttcgcagatgcatgccaggcatcaggggcagaagcactgccggtggccctcaaacagtatgcagactcccataccacccccgatcttccaccgccttcccagaagccaagtttcctgggggaaaatgaaacactgcctctctccatacttgctttgacatctgttgctattctgactgctctgctggtgctcctatgctctatatgctacctgatctgctgcaggaagaaaaaatctcacggccatgctcaccagccgcttatgcacttcccttaccctccagagttgggcgaccacaaactttaagtctgcagtagctatctgcccatcccttgtcagtcgacagcgatgagccccactaatctaacggcctctggacttacaacattgtctcttaatgagaccaccgctcctcaagacctgtacgatggtgtctccgcgctggttaaccagtgggatcacctgggcatatggtggctcctcataggagcagtgaccctgtgcctaatcctggtctggataatctgctgcatcaaaagcagaagacccaggcggcggcccatctacaggcccttcgtcatcacacctgaagatgatgatggcaccacgtccaggctgcagagcctaaagcagctactcttctcttttacagcatggtaaattgaacatgcctcgcattttcatctacttgtttcttcttccactctttttgggctcttctacattggcagctgtgtcccacatcgaggtagactgcatctcgcccttctcagtctacttactcttcggctttgtcatttgcaactttgtctgcagcgttatcactgtagtgatctgcttcatacagtgcatcgactacgtctgcgtacgggtggcctattttagacaccacccccagtatcgcaacagggacatagcggctctcctaagacttgtttaaatcatgcccaaattaactgtgattgctcttctgattatctgctgcgtcctagccgcgattgggactcagcctactaccaccaccaccagcgctcccagaaagagacatgtttcctgcagcttcaaacgtccctggaatataccccaatgctttactgatgaacctgaaatctctttggcttggtacttcagcgtcaccgcccttctcatcttctgcagtacggttattgcccttgccatttacccttcccttgacctgggctggaatgctgtcaactctatggaatatcccaccttcccagaaccagacctgccagacctggttgttctaaacgcgtttcctcctcctcccgttcaaaatcagtttcgccctccgtccccgacgcccactgaggtcagctactttaatctaacaggcggagatgactgaaaacctagacctagaaatggacggcctctgcagcgaacaacgcatactagagaggcgccggcaaaaagcagagctcgagcgtcttaaacaagagctccaagacgcggtggccatacaccagtgcaaaaaaggtgtcttctgtctagtgaaacaggccacgctcacctatgaaaaaacaggtgacacccaccgcctaggatacaagctgcccacacaacgccagaagttcgcccttatgataggcgaacaacccatcaccgtcacccagcactctgtggagacagaaggctgcatacacgctccctgcaggggcgctgactgtctctacaccttgatcaaaaccctctgcggccttagagacctcatccctttcaattgatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtcccttttcccacccctccctttgtgtcccccgcaggaatgcaagaaaacccccctggagtgctatccctacgccttgcagaacccttgaccacctccaatggagcgctgaccctaaaaatggggggtggtttgaccctggacgaagaaggaaagcttacttcccaaaatattaccagtgttgatcctcctcttaaaaaaacaaaaaacaatatcagtctgcagactgcctccccccttgccgtcagctcgggagccctcacacttttcgctactcctcccctggcagttaatgacaataacctaactgtgcagtctcaggctccccttacactggaaaactcaaaactaagtctggccaccaaaggccccctaaccgtttctgaaggaaaacttgccctagaaacagaggctcccttgcatgcaagcgacagcagtagcctaggccttagtgtaacggccccactgagcattagcagcgacagcctaggactagacttgcaagcgcccattatttctgaaaatggaaaactgggcctaagagtaacaggtcccctaactgtggccagcagtattgatgctttgacagtagccacaggcagcggtattggacttgatagcaacacgcgcctacaggcaaaattggtcgcgcccctaggctttgacaccaatggcaacattaagctcagcacttcgggcggcatgagactgaacaatggcacacttatactagatgtaaactacccatttgaggctcaaggtcaacttagtctaagagtgggttcgggtccactgtatgtagactccaacacacataacctaaccgctagatgccttagagggctatacataacgtcatctaataaccaaaccggcctggaggccaacataaaacttacaaaaggacttgtgtttgatggaaatgccatagcagttaatgttagcaaagggctagaatacagtaccactgaaacagcgcagggtgtaaatcccatacagactaaaataggtttgggcatggaatatgataccaatggagccataaagccaagactaggctctggtttgagctttgataattcaggagctattgtagtgggaaacaaaaatgatgacactcttactctgtggactacaccagacccatctcccaactgtcagattaactcggaaaaagatgctaaactaaccttggtactaaccaagtgcggtagtcaaattgtaggcacagtatctgcctttgctcttaaaggcagccttgccccaattaatggcacagtgagctcagttagtatattcctaagatttaatgaaaatggggtactgatgagcaactcatcgttggaaagccaatactggaattacaggaatggaaattcaactaatgccacaccatatacaaatgcactaggttttatgcctaacctggcagcttatcccaaaggccaggcaacgactgcaaaaagcagcatcattagccaggtttacatgaatggtgacacttccaaacctatgatatttacaataacttttaatgggcttgaaacagaggaaactcaggtcagtacatattccatgacattttcatggaggtggacaaatggagactacgtggggcactattttaaaacaaactcctttactttctcctacattgcccaagaataaagaaagcacagagatgcttgtttttgatttcaaaattgtgtgcttttatttatttcaagcttacagtatttccagtagtcattcgaatagagcttaattaaactgcatgagaacccttccacatagcttaaattagcaccagtgcaaatggagaaaaatcaacatacctttttatccagatatcagagaactctagtggtcagttttcccccaccctcccagctcacagaatacacagtcctttccccccggctggctttaaacaacactatctcattggtaacagacatattcttaggtgtaataatccacacggtctcttggcgggccaaacgctggtcggtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgcagcaacaaggcgcgcagcaactcctgccgccgcctctccgtacggcaggaatgcaacggcgtggtggtctcctccgcgataatccgcaccgctcgcagcatcagcatcctcgtcctccgggcacagcagcgcatcctgatctcactgagatcggcgcagtaagtgcagcacaaaaccaagatgttatttaagatcccacagtgcaaagcgctgtacccaaagctcatggcgggaaggacagcccccacgtgaccatcataccagatcctcaggtaaatcaaatgacgacctctcataaacacgctggacatgtacatcacctccttgggcatgtgctgattcaccacctctcgataccacaagcatcgctgattaattaaagacccctcgagcaccatcctgaaccaggaagccagcacctgaccccccgccaggcactgcagggaccccggtgaatcgcagtggcagtgaagactccagcgctcgtagccgtgaaccatagagctggtcattatatccaaattggcacaacacagacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgttcggtgtagtagttgtaatacagccactccctgagaccgtcaaggcgctccctggcgtccggatctatgacaacaccgtcctgcagcgccgccctgatgacatccaccaccgtagagtatgccaagcccagccaggaaatgcattcactttgacagcgagagataggaggagcggggagagatggaagaaccatgatagtaaagagaacttttattccaatcgatcttctaagatatcaaagtggagatctataagatgacactggtctcctccgctgagtcgatcaaaaataacagctaaaccacaaacaacacgattggtcaaatgctccacaagggcctgcagcataaaattgcctcggaactccaccgcaagcataacatcaaagccaccgcctctatcgtgatcaagaataaaaaccccacagctatccaccagacccatatagttttcatctctccatcgtgaaaaaagatttacaagctcctcctttaaatcacctccaaccaattgaaaaagttgaaccagaccgccctccaccttcattttcagcaagcgtatcatgattgcaaaaattcaggctcctcagacacctgtataagattgagaagcggaacgttaacatcgatgtttcgctcgcgtaaatcacgcctcagtgcaagcataatataatcccacaggtcggagcggatcagcgaggacacctccccgccaggaaccaactcaacggagcctatgctgattataatacgcatattcggagctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacgaccacagaaaaatgcacaatttttctctcaaacatgactgcgagccctgcaaaaaataaaaaagaaacattacacaagagtagcctgtcttacgatgggatagactactctaaccaacataagacgggccacaacatcgcccgcgtggccataaaaaaaattgtccgtgtgattaaaaagaagcacagatagctggccagtcatatccggagtcatcacgtgtgaacccgtgtagacccccgggttggacacatcggccaaagaaagaaagcggccaatgtacccaggaggaattataacactaagacgaagatacaacagaataaccccatgagggggaataacaaagttagtaggtgaataaaaacgataaacacccgaaactccctcctgcgtaggcaaaatagcaccctccccttccaaaacaacatatagcgcttccacagcagccatgacaaaagactcaaaacactcaaaagactcagtcttaccaggaaaataaaagcactctcacagcaccagcactaatcagagtgtgaaaagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccgctttctcacgatacgtcacttccgcaagaaaagcaaaactacatttcccacatgtgtaaaaacgaaaccccgccccttctaaccgcccacaacttacatcatcaaaacgtaaagtcctacgtcacccgccccgcctctccccgcccacctcattatcatattggccacaatccaaaataaggtatattattgatgatg

SEQ ID NO: 16 - DNA, 37074 bp, Gorilla beringei graueri
catcatcaataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcaccgtcatttgacgcggagggtatttaaacccgctgcgctcctcaagaggccactcttgagtgccagcgagaagagttttctcctctgctccgcttcggtgatcgaaaaatgagacacatagcctgcactccgggtcttttgtccggtcgggcggcggccgagcttttggacgctttgatcaatgatgtcctgagcgatgattttccgtctactacccactttagcccacctactcttcacgaactgtacgatctggatgtactggtggatgtgaacgatcccaacgaggaggcggtttctgcgttttttcccgagtctgcgctgttggccgctcaggagggatttgacctacacactccgccgcctattttagagtctccgctgccggagcccagtggtataccttatatgcctgaactgcttcccgaagtggtagacctgacctgccacgagcctggctttccgcccagcgacgatgatggtgagccttttgttttagactttgctgagatacctgggcacggttgcaggtcttgtgcatatcatcagagggttaccggagaccccgaggttaagtgttcgctgtgctatatgaggatgacctcttcctttatctacagtaagtttttgtctaggtgggcttttgggtaggtgggttttgtgtcagaacaggtgtaaacgttgcttgtgttttttgtacctgtaggtccggtgtccgagccagacccggagcccgaccgcgatcccgagccggatcccgagcctcctcgcaggacaaggaaactaccttccattctgtgcaagtctcagacacctgtaaggaccagcgaggcagacagcaccgactctggcacttctacctctccccctgaaattcacccagtggttcctctgggtatacataaacctgttgctgttagagtttgcgggcgacgccctgcagtacagtgcattgaggacttgcttcacgatcccgaggaacctttggacttgagccttaaacgccctaggcaataaaccccacctaagtaataaaccccacctaagtaataaaccctgccgcccttggttattgagatgacgcccaatgtttgcttttgaatgacttcatgtgtgtaataaaagtgagtgtgatcataggtctcttgtttgtctgggcggggcttaagggtatataagtttctcggggctaaacttggttacacttgaccccaatggaggcgtgggggtgcttggaggagtttgcggacgtgcgccgtttgctggacgagagctctaaccatacctatactatttggaggtatctgtggggctctactcaggccaagttggtctccagaattaagcaggattacaagtgcgattttgaagagctttttagttcctgcggtgagcttttgcaatccttgaatctgggccatcaggctattttccaggaaaaggttctctcgactttggatttttccactcccgggcgcaccgccgcttgtgtggcttttgtgtcttttgtgcaagataaatggagcgaggagacccacctgagtcacggctacgtactggatttcatggcgatggctctttggagggctcacaacaaatggaagattcagaaggaactgtacggttccgccctacgtcgtccacttttgtcgcgacaggggctgaggtttcccgaccatcggcagcatcagaatctggaagacgagtcggaggagcgagcggaggagaagatcagcttgagagccggcctggaccctcctcaggaggaatgaatctcccgcaggtggttgacctgtttccagaactgagacgggtcctgactatcagggaggatggtcagtttgtgaagaagtttaagagggatcggggtgagggagatgatgaggcggctagcaatttagcttttagtctgatgactcgccaccgaccggaatgtattacctatcagcagattaaggagagttgtgccaacgagctggatcttttgggtcagaagtatagcatagaacagcttaccacttactggcttcagcctggggatgattgggaagaggcgatcagggtgtatgcaaaggtggccctgcggcccgattgcaagtataagattactaagttggttaatattagaaactgctgctatatttctgggaacggggccgaagtggagatagatactcaggacagggtggcttttaggtgttgcatgataaacatgtggcccgggatactggggatggatggggtggtgttcatgaatgtgaggtttacgggccccaactttaatggcacggtgttcatgggcaacaccaacttgctcctgcatggtgcgagtttctatgggtttaataacacctgtatagaggcctggaccgatgtaaaggttcgaggttgttccttttatagctgttggaaggcggtggtgtgtcgccctaaaagcaggggttctgtgaaaaaatgcttgtttgaaaggtgcaccttaggcatcctctctgagggcaactccagggtgcgccataatgtggcttcgaactgcggttgcttcatgcaagtgaagggggtgagcgttatcaagcataactcggtgtgtggaaactgcgaggatcgcgcctcccagatgctgacctgctttgatggtaactgtcacctgttgaagaccattcatataagcagccaccccagaaaggcctggcccgtgtttgagcataacatcctgacccgctgctccttgcatctgggggtcaggaggggtatgttcctgccttaccagtgtaactttagccacactaaaatcctgctggaacccgagtgtatgaccaaggtcagcctaaatggcgtgtttgatgcgactctgagaatctggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgcaccagggccgagtttgggtctagcgatgaggataccgattgaggtgggtaaggtgggcgtggctagaagggtggggcgtgtataaattgggggtctaagggtctctctgttttgtcttgcaacagccgccgccatgagcgacaccggcaacagctttgatggaagcatctttagcccctatctgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcagcgcggcctctcgcgcgtctgctcgggatgagaaactgaccgctctgctgcttaaactggaagacttgacccgggagctgggtcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataagacatctttacaaatcgggggcggagggtcccggactggggtatgatggtaccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagcctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcgccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtcctgaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaaggaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacgggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcctcctggagatctcctcgtccggcgcgctccacggtggccgccaggtcgttggagatgcgacccatgagctgcgagaaggcgttgagcccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacgccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcataaggcggtggtatccgtagatgtacctggacatccaggtgatgccggcggcggtggtggtggcgcgcgcgtagtcgcggacccggttccagatgtttcgcaggggcaagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgagggccgtggcagccccgtcctcaggaccccgccagccgacttctccagttacgggagcgagccccttttgtttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtgaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggacgatgaccaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgagtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggatgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttgaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggaaacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacgcaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcattaaccgcctgatggactacttgcatcgggcggcggccgtgaaccccgagtacttcactaatgccattctgaatccccactggatgccccctccgggtttctacaacggggacttcgaggtgcccgaggttaacgacgggttcctctgggatgacatggatgacagtgtgttctcacccaacccgctgcgcgccgcgtctctgcgattgaaggagggttctgacagggaaggaccgaggagtctggcctcctccctggctctgggagcggtgggcgcggcggcgcggggcagtagccccttccccagcctggcagactctctgaacagcgggcgggtgagcaggccccgcttgctaggcgaggaggagtatctgaacaactccctgctgcagcccgcgagggacaaaaacgctcagcggcagcagtttcccaacaatgggatagagagcctggtggacaagatgtccagatggaagacgtatgcgcaggagtacaaggagtgggaggaccgccagccgcggcccctgccgccccctaggcagcgctggcagcggcgcgcgtccaaccgccgctggaggcaggggcccgaggacgatgatgactctgcagatgacagcagcgtgctggacctgggcgggagcgggaaccccttttcgcacctgcgcccccgcctgggcaagatgttttaaaagagaaaaaataaaaactcaccaaggccatggcgacgagcgttggttttttgttcccttccttagtatgcgacgcgcggcgatgttcgaggaggggcctcccccctcttacgagagcgcgatgggattttctcctgcgacgcccctacagcctccctacgtgcctcctcggtacctgcaacctaccgggggaagaaatagcatctgttactctgagctgcagcccctgtatgacaccaccaaagtgtacctggtggacaacaagtctgcggacgtggcctccctgaactaccagaacgaccacagcgattttttgaccaccgtgatccaaaacaatgacttcaccccaaacgaggccagcacccagaccataaacctggacaacaggtcgcactggggcggtgatctgaagaccatcttgcacaccaacatgcccaacgtgaatgagtttatgtttactaactcttttaaggcgcgggtaatggtggcgcgcgacgataagggagtgcctaaatacgagtgggtggactttacactgcccgagggcaactactccgagatcatgactcttgacctgatgaacaacgcgatcgtggagcactacttgaaagtaggcaggcagaacggggtaaaagaaagcgatattggagttaagtttgacaccaggaactttcgcctgggatgggaccccgagacggggttggttatgcccggggtttacactaatgaagcttttcaccccgatatagtgctcttgcccggatgcggggtggacttcacccaaagccggctgagcaacctgctgggcattcgaaagcgccagccattccaggaggggtttcaaatcacttatgagcatttggaagggggcaacattccggcgcttctggatttggtcgcctacgaggagagtttgaaatccgaggaaagcggggataacactgacaagggcggcgaggagcaagccggcgatggcgacactgcttcggtagaaaacgaaagtgcgtccgtggtggaggcggcggcggtagcgaccgcagagccggagaccgtagaggaggatatgaatgatagcgcaatcagaggagactcgtttattccccggggcgaagaaaagaaggcggaggctgcggcagcagtcgaagcagagcccaaagtcgagtcggagatcatggaggaggatttgaatgataacgcgatcagaggtgatacgtttgtgccgcggggcgaagaaaaaaaagcggaggcggaggccgcggctgaggaggcggccgaggctgtggcagccaccgcggcggtgactgaaacaactgaggagcaggttcaggccgagcaggttcaaaagaagcccgtgattaaagccctaacacaagatagcaaggagcgcagttacaacttgattcccggtagtactgacaccgagtaccgcagctggtacctggcatacaactacggcgacccggtcaaaggggtgcgctcgtggactctgctttgcacgccggacgtcacctgcggctccgagcagatgtactggtcgttgccaaacatgatgcaagacccggtgaccttccgctccacgcggcaggttaacaacttcccggtggtgggcgccgaactgctgcccgtgcactccaagagcttttacaacgagcaggccgtgtactcccagctgatccgccaggccacctctctgacccacgtgttcaatcgctttcccgagaaccagattttggcgcgcccgccggcccccaccatcactaccgtcagtgaaaacgttcctgctctcacagatcacgggacgctaccgctgcgcaacagcatctcaggagtccagcgagtgaccattactgacgccagacgccggacctgcccctacgtttacaaggccttgggcatagtctcgccgcgcgtcctctccagccgcactttttaaaacacatattcacccacgcttcaaagattatgtctatacttatctcacccagcaataacaccggctgggggctgcgcgcgcccagcaagatgtttggaggggcgagaaaacgttccgagcagcacccagtgcgcgtgcgcggccactaccgcgcgccctggggagcgcacaagcgcgggcgcgcagggcgcaccactgtggacgacgccattgactccgtagtggagcaggcgcgccactacacacccggcgcgccgtccgcccccgccgtgtccaccgtggacgaggcgatcgaaagcgtggtacagggcgcgcggcactatgccaaccttaaaaatcgccgccgtcgcgtggcccgccgccatcgccggagaccccgggccaccgccgccgcgcgccttgctaaggctctactcaggcgcgccaggcgaactggccgccgggccgccatgagggccgcacggcgggctgccgccagtgcggccgccgcggccccacgggcacgaaggcgcgcggccgctgccgccgccgccgccatttccagcttggcctcaacgcggcgcggtaacatatactgggtgcgcgactcgataaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgatgacgaggcggtggagtttgtccgccgcatggcacccaggcgccccgtgcagtggaagggtcggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtgaccctgcaacaggtgctgcctttgagcgcgcccagcgagcataagcgagggttgaagcgcgagggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcagcggccagcgccaccaccggcaccgcttcggtagaggtgcagacggacccctggctacccgccgccgctgtcgccgccgccgccgccccccgttctcgcgggcgcaagagaaattatccagtggccagcgcgctcatgccccagtacgcactgcatccatccatcgcgcccacccccggctaccgcgggtattcgtaccgcccgcgcagatcggccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcatttttttggaggaaaaaataaaaaagtctagactctcacgctcgcttggtcctgtgactattttgtagaaaaaagatggaagacatcaactttgcgtcgctggccccgcgtcatggctcgcgcccgttcatgggagactggacagatatcggcaccagcagtatgagcggtggcgccttcagctggggcagtctgtggagcggccttaaaaattttggttccaccattaaaaactatggcaacaaagcgtggaacagcagcacgggccagatgctaagagacaagttgaaagagcagaacttccaggagaaggtggcgcagggcctggcctctggcatcagcggggtggtggacatagctaaccaggccgtgcagaaaaagataaacagtcatctggacccccgccctcaggtggaggaaacgcctccagccatggagacggtgtttcccgagggcaaaggcgaaaagcgcccgcggcccgacagggaagagaccctggtgtcacacaccgaggagccgccctcttacgaggaggcactcaaggccggcctgcccaccactcgccccgtagctcccatggccacaggtgtggtgggccataaacaacacacccccgcaacactagatctgcccccgccgtccgagccgccgcgtcagccaaagacggcgacggtgcccgctccctccacttccgccgccaacagagtgtccctgcgccgcactacgggcgcccctcggggaccgcgactgagcggcaactggcagagcacactgaacagcattgtgggcctgggagtgaaaagtgtgaagcgccgccgttgctactgaatgagcaagctagctaacgtgttatatgtgtgtatgcgtcctatgtcgccgccagaggagctgttgagccgcccgcgccgtctgcactccagcgaatttcaagatggcgaccccttcgatgatgccacagtggtcgtacatgcacatctcgggccaggacgcctcggagtacctgagccccgggctggtgcagttcgcccgcgccaccgacagctacttcagcctaagtaacaaatttaggaaccctacggtggcacccacccacgatgtgaccacggaccggtcgcagcgcctgacgctgcggtttatccccgtggatcgggaggacactgcctactcttacaaggcgcgcttcacgctagccgtgggcgacaaccgcgtgctggacatggcctccacctactttgatatccggggtgtgctggacaggggtcccacctttaagccctactcgggcactgcctacaactccctggctcctaaaggcgctcccaattcttgcgagtgggatgaaaaaactaatactgctgaagcagccattgaaaatgaagaagagctggcggatgagccagaagagcaagcagaagaggctataaaaaccaatgtgtttgcccaggcgccatattctggcaatgcaatttccaaagaaggaatacaagtaggcatagaaggcattggagagcaagtaaaagccgtatacgcagacaaaacctaccagccggaacctcaggttggagaaactcaatggaatgagactgaaataaatcatggagcaggaagggtgctgaagaagaccactcccatgaagccttgctatggttcttatgctaaacctactaatgaatatggaggccagggcatccttgtagaaaaaaatggcaaaatggaaagccaggtggaaacacagttttttgctcttgacggtgaaaatgataatagtccaaaagtggtgttgtatagcgaagatgtaaacttggatactcctgacacacacctatcatacaaacctagcgcccaagatgtaaactctaaagaaatgttgggccaacaggccatgcccaacaggccaaatcttattgcttttagggacaactttattggacttatgtactacaacagcactggcaacatgggagtgctggcaggacaggcctcccaactaaatgccgtggtagacttgcaagacagaaacacagagttgtcataccagctgatgcttgattccattggagacagatcaagatattttgccatgtggaaccaggcggttgatagttacgatccagatgttagaattattgaaaaccatggcacagaggatgaacttccaaactactgttttcctttgggaggaatatttaatactcagagttttaaaaaggtaaaacctggaacggataacggatgggaaacagatgatgacttttcagataaaaatgaaataagagttggcaacaactttgccatggagatcaatatccaggcaaacctgtggagaagcttcttgtattccaatgtggctctctacctgccagataagatgaagtactctccaaccaacatagacatttccaccaacactaacacctatgactacatgaacaaaagagtggcgcctccaggcctggtggactgctatgtcaatctgggggccaggtggtcccttgatgtaatggataacatgaacccctttaaccaccaccgcaatgcgggcctgcgataccgttccatgcttctgggtaacggccgctacgtgcccttccacatccaggtgccccaaaagttctttgccatcaaaagccttctactcttgcctggctcgtacacctacgaatggaatttcagaaaggatgtgaacatggtcctacagagctctctgggcaacgaccttagggtggatggggccagcatcaagtttgacagcatcaccctttatgctacctttttccccatggcccacaacaccgcttccacgcttgaggccatgctcagaaacgacaccaacgaccagtccttcaatgactacctctctggggccaacatgctctaccccatccccgccaacgctaccaacgtgcccatctccattccctctcgcaactgggccgccttcagaggctgggcatttacccgccttaagaccaaggagaccccctccctgggctcgggttttgacccctactttgtctactcgggatccatcccctacctggatggcaccttctacctcaaccacacttttaagaagatatccatcatgtatgactcctctgtcagctggccgggcaacgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccgttggcatcactcaccagcacaacaactcgggattcgtgggctacctggcacccaccatgcgcgagggacaggcctaccccgccaacttcccctaccccttgataggcaagaccgcggtcgacagcgtcacccagaaaaagttcctctgcgaccgcaccctctggcgcatccccttttctagcaacttcatgtccatgggcgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacttgctacctctttgacccttttggcttctccgatcagcgcctcaagcagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcgcatccggggggccacctctttctgccacttgcaagaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggttcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattatgcacgctggccagcaggctctcgtcgctgatcatgtcgctgtccagatcctccgcgttgctcagggcgaatggggtcatcttgcagacctgcctgcccaggaaaggcggcagcccgggcttgccgttgcagtcgcagcgcaggggcatcagcaggtgcccgcggcccgactgcgcctgcgggtacagcgcgcgcatgaaggcttcgatctgcctgaaagccacctgcgccttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtcccgtgcagacacttcaggtcgccctccgtctgggtgcagcggtgctcccacagcgcgcaaccggtgggctcccaattcttgtgggtcacccccgcgtaggcctgcaggtaggcctgcaagaagcgccccatcatggccacgaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagcgccgcctgctcttcttcgtcttcgctgtctaccactatctctggggaagggcttctccgctctgcggcggtgcgcttcttttttttcttgggagcagccgtgacggagtccgccacggcgacggaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcctctcgagctggtcttggtctcgactggccattgtatcctcctcctcctaggcagagagacataaggagtctatcatgcaagtcgagaaggaggagagcttaaccaccccctctgacaccgccgatgcgcccgccgtcgccgtcgcccccgctgccgccgacgcgcccgccacaccgagcgacacccccgcggacccccccgccgacgcacccctgttcgaggaagcggccgtggagcaggacccgggctttgtctcggcagaggaggatttgcgagaggaggagaataaggagaagaagccctcagtgccaaaagatgataaagagcaagacgagcacgacgcagatgcacaccagggtgaagtcgggcggggggacggagggcatggcggcgccgactacctagacgaagggaacgacgtgctcttgaagcacctgcatcgtcagtgcgccatcgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgccttcgtggtgcccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtgccaaagatctttgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctaaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgcggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgtctggaggagcgcaacctcaaagagctggagaagctcctgcagcgcgcgctcaaagacctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaggaccaatcccgcccgcccaaggcggagctgaccgcctgcgtcatcacccagggcgagatcctaggccaattgcaagccatccaaaaagcccgccaagattttttgctgaagaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcgattaccaccacgccccgcaataatcccaaccccagggagtggcccgcgtccctggtgtatcaggaaattcccggccccaccaccgtactacttccgcgtgattcccaggccgaagtccaaatgactaactcaggggcgcagctcgcgggcggctgtcgtcacagggtgcggccccctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctccggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgagaaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgattttatagaaccccagtgcaatatcacttataaatctgaatataacctctgcactatcctaattaaatgcgttactcaacacgatgaggtaactgttagatacaaagatcaatcaaaaagagacgcactttacagcagctggcaaccaggagatgaacaaaaatacaatgtgaccgtcttccagggcaaactctccaaaacttacaattacactttcccattcgaggagatgtgtgagtttgtcatgttcatgtcaaagcagtacaagatgtggcctccgactccccagggctgtgtggaaaatccaggctctttctgcatgatctctctctgtgtaactgtgctggcactaatactcacgcttttgtatatcagatttaaatcaaggcaaagcttcatcgatgaaaagaaaatgccttaatcgcttttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatttaaccttgattgatgttcaattgctggatgcgggctactattatgggcagctgggtacaatcgttaattactggagaccccacaaagattacatgcttcacgtagtaaagggtccccttagcagcccgaccactaccaccacctctaccacacccactaccaccactactcccatcaccagcactgccacccagcctcctcatagcagaacaaccacttttatcaattccaagtcccactccccccacattgccggcgggccctccgcctcaaactccgagaccaccgagatctgcttctgcaaatgctctgacgccattgcccaggatttggaagaccacgaggaagatgagcatgacttcgcagatgcatgccaggcatcaggggcagaagcactgccggtggccctcaaacagtatgcagactcccataccacccccgatcttccaccgccttcccagaagccaagtttcctgggggaaaatgaaacactgcctctctccatacttgctttgacatctgttgctattctgactgctctgctggtgctcctatgctctatatgctacctgatctgctgcaggaagaaaaaatctcacggccatgctcaccagccgcttatgcacttcccttaccctccagagttgggcgaccacaaactttaagtctgcagtagctatctgcccatcccttgtcagtcgacagcgatgagccccactaatctaacggcctctggacttacaacattgtctcttaatgagaccaccgctcctcaagacctgtacgatggtgtctccgcgctggttaaccagtgggatcacctgggcatatggtggctcctcataggagcagtgaccctgtgcctaatcctggtctggataatctgctgcatcaaaagcagaagacccaggcggcggcccatctacaggcccttcgtcatcacacctgaagatgatgatggcaccacgtccaggctgcagagcctaaagcagctactcttctcttttacagcatggtaaattgaacatgcctcgcattttcatctacttgtttcttcttccactctttttgggctcttctacattggcagctgtgtcccacatcgaggtagactgcatctcgcccttctcagtctacttactcttcggctttgtcatttgcaactttgtctgcagcgttatcactgtagtgatctgcttcatacagtgcatcgactacgtctgcgtacgggtggcctattttagacaccacccccagtatcgcaacagggacatagcggctctcctaagacttgtttaaatcatgcccaaattaactgtgattgctcttctgattatctgctgcgtcctagccgcgattgggactcagcctactaccaccaccaccagcgctcccagaaagagacatgtttcctgcagcttcaaacgtccctggaatataccccaatgctttactgatgaacctgaaatctctttggcttggtacttcagcgtcaccgcccttctcatcttctgcagtacggttattgcccttgccatttacccttcccttgacctgggctggaatgctgtcaactctatggaatatcccaccttcccagaaccagacctgccagacctggttgttctaaacgcgtttcctcctcctcccgttcaaaatcagtttcgccctccgtccccgacgcccactgaggtcagctactttaatctaacaggcggagatgactgaaaacctagacctagaaatggacggcctctgcagcgaacaacgcatactagagaggcgccggcaaaaagcagagctcgagcgtcttaaacaagagctccaagacgcggtggccatacaccagtgcaaaaaaggtgtcttctgtctagtgaaacaggccacgctcacctatgaaaaaacaggtgacacccaccgcctaggatacaagctgcccacacaacgccagaagttcgcccttatgataggcgaacaacccatcaccgtcacccagcactctgtggagacagaaggctgcatacacgctccctgcaggggcgctgactgtctctacaccttgatcaaaaccctctgcggccttagagacctcatccctttcaattgatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtcccttttcccacccctccctttgtgtcccccgcaggaatgcaagaaaacccccctggagtgctatccctacgccttgcagaacccttgaccacctccaatggagcgctgaccctaaaaatggggggtggtttgaccctggacgaagaaggaaagcttacttcccaaaatattaccagtgttgatcctcctcttaaaaaaacaaaaaacaatatcagtctgcagactgcctccccccttgccgtcagctcgggagccctcacacttttcgctactcctcccctggcagttaatgacaataacctaactgtgcagtctcaggctccccttacactggaaaactcaaaactaagtctggccaccaaaggccccctaaccgtttctgaaggaaaacttgccctagaaacagaggctcccttgcatgcaagcgacagcagtagcctaggccttagtgtaacggccccactgagcattagcagcgacagcctaggactagacttgcaagcgcccattatttctgaaaatggaaaactgggcctaagagtaacaggtcccctaactgtggccagcagtattgatgctttgacagtagccacaggcagcggtattggacttgatagcaacacgcgcctacaggcaaaattggtcgcgcccctaggctttgacaccaatggcaacattaagctcagcacttcgggcggcatgagactgaacaatggcacacttatactagatgtaaactacccatttgaggctcaaggtcaacttagtctaagagtgggttcgggtccactgtatgtagactccaacacacataacctaaccgctagatgccttagagggctatacataacgtcatctaataaccaaaccggcctggaggccaacataaaacttacaaaaggacttgtgtttgatggaaatgccatagcagttaatgttagcaaagggctagaatacagtaccactgaaacagcgcagggtgtaaatcccatacagactaaaataggtttgggcatggaatatgataccaatggagccataaagccaagactaggctctggtttgagctttgataattcaggagctattgtagtgggaaacaaaaatgatgacactcttactctgtggactacaccagacccatctcccaactgtcagattaactcggaaaaagatgctaaactaaccttggtactaaccaagtgcggtagtcaaattgtaggcacagtatctgcctttgctcttaaaggcagccttgccccaattaatggcacagtgagctcagttagtatattcctaagatttaatgaaaatggggtactgatgagcaactcatcgttggaaagccaatactggaattacaggaatggaaattcaactaatgccacaccatatacaaatgcactaggttttatgcctaacctggcagcttatcccaaaggccaggcaacgactgcaaaaagcagcatcattagccaggtttacatgaatggtgacacttccaaacctatgatatttacaataacttttaatgggcttgaaacagaggaaactcaggtcagtacatattccatgacattttcatggaggtggacaaatggagactacgtggggcactattttaaaacaaactcctttactttctcctacattgcccaagaataaagaaagcacagagatgcttgtttttgatttcaaaattgtgtgcttttatttatttcaagcttacagtatttccagtagtcattcgaatagagcttaattaaactgcatgagaacccttccacatagcttaaattagcaccagtgcaaatggagaaaaatcaacatacctttttatccagatatcagagaactctagtggtcagttttcccccaccctcccagctcacagaatacacagtcctttccccccggctggctttaaacaacactatctcattggtaacagacatattcttaggtgtaataatccacacggtctcttggcgggccaaacgctggtcggtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgcagcaacaaggcgcgcagcaactcctgccgccgcctctccgtacggcaggaatgcaacggcgtggtggtctcctccgcgataatccgcaccgctcgcagcatcagcatcctcgtcctccgggcacagcagcgcatcctgatctcactgagatcggcgcagtaagtgcagcacaaaaccaagatgttatttaagatcccacagtgcaaagcgctgtacccaaagctcatggcgggaaggacagcccccacgtgaccatcataccagatcctcaggtaaatcaaatgacgacctctcataaacacgctggacatgtacatcacctccttgggcatgtgctgattcaccacctctcgataccacaagcatcgctgattaattaaagacccctcgagcaccatcctgaaccaggaagccagcacctgaccccccgccaggcactgcagggaccccggtgaatcgcagtggcagtgaagactccagcgctcgtagccgtgaaccatagagctggtcattatatccaaattggcacaacacagacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgttcggtgtagtagttgtaatacagccactccctgagaccgtcaaggcgctccctggcgtccggatctatgacaacaccgtcctgcagcgccgccctgatgacatccaccaccgtagagtatgccaagcccagccaggaaatgcattcactttgacagcgagagataggaggagcggggagagatggaagaaccatgatagtaaagagaacttttattccaatcgatcttctaagatatcaaagtggagatctataagatgacactggtctcctccgctgagtcgatcaaaaataacagctaaaccacaaacaacacgattggtcaaatgctccacaagggcctgcagcataaaattgcctcggaactccaccgcaagcataacatcaaagccaccgcctctatcgtgatcaagaataaaaaccccacagctatccaccagacccatatagttttcatctctccatcgtgaaaaaagatttacaagctcctcctttaaatcacctccaaccaattgaaaaagttgaaccagaccgccctccaccttcattttcagcaagcgtatcatgattgcaaaaattcaggctcctcagacacctgtataagattgagaagcggaacgttaacatcgatgtttcgctcgcgtaaatcacgcctcagtgcaagcataatataatcccacaggtcggagcggatcagcgaggacacctccccgccaggaaccaactcaacggagcctatgctgattataatacgcatattcggagctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacgaccacagaaaaatgcacaatttttctctcaaacatgactgcgagccctgcaaaaaataaaaaagaaacattacacaagagtagcctgtcttacgatgggatagactactctaaccaacataagacgggccacaacatcgcccgcgtggccataaaaaaaattgtccgtgtgattaaaaagaagcacagatagctggccagtcatatccggagtcatcacgtgtgaacccgtgtagacccccgggttggacacatcggccaaagaaagaaagcggccaatgtacccaggaggaattataacactaagacgaagatacaacagaataaccccatgagggggaataacaaagttagtaggtgaataaaaacgataaacacccgaaactccctcctgcgtaggcaaaatagcaccctccccttccaaaacaacatatagcgcttccacagcagccatgacaaaagactcaaaacactcaaaagactcagtcttaccaggaaaataaaagcactctcacagcaccagcactaatcagagtgtgaaaagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccgctttctcacgatacgtcacttccgcaagaaaagcaaaactacatttcccacatgtgtaaaaacgaaaccccgccccttctaaccgcccacaacttacatcatcaaaacgtaaagtcctacgtcacccgccccgcctctccccgcccacctcattatcatattggccacaatccaaaataaggtatattattgatgatg

SEQ ID NO: 17 - DNA, 37073 bp, Gorilla beringei graueri
catcatcaataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcaccgtcatttgacgcggagggtatttaaacccgctgcgctcctcaagaggccactcttgagtgccagcgagaagagttttctcctctgctccgcttcggtgatcgaaaaatgagacacatagcctgcactccgggtcttttgtccggtcgggcggcggccgagcttttggacgctttgatcaatgatgtcctgagcgatgattttccgtctactacccactttagcccacctactcttcacgaactgtacgatctggatgtactggtggatgtgaacgatcccaacgaggaggcggtttctgcgttttttcccgagtctgcgctgttggccgctcaggagggatttgacctacacactccgccgcctattttagagtctccgctgccggagcccagtggtataccttatatgcctgaactgcttcccgaagtggtagacctgacctgccacgagcctggctttccgcccagcgacgatgatggtgagccttttgttttagactttgctgagatacctgggcacggttgcaggtcttgtgcatatcatcagagggttaccggagaccccgaggttaagtgttcgctgtgctatatgaggatgacctcttcctttatctacagtaagtttttgtctaggtgggcttttgggtaggtgggttttgtgtcagaacaggtgtaaacgttgcttgtgttttttgtacctgtaggtccggtgtccgagccagacccggagcccgaccgcgatcccgagccggatcccgagcctcctcgcaggacaaggaaactaccttccattctgtgcaagtctcagacacctgtaaggaccagcgaggcagacagcaccgactctggcacttctacctctccccctgaaattcacccagtggttcctctgggtatacataaacctgttgctgttagagtttgcgggcgacgccctgcagtacagtgcattgaggacttgcttcacgatcccgaggaacctttggacttgagccttaaacgccctaggcaataaaccccacctaagtaataaaccccacctaagtaataaaccctgccgcccttggttattgagatgacgcccaatgtttgcttttgaatgacttcatgtgtgtaataaaagtgagtgtgatcataggtctcttgtttgtctgggcggggcttaagggtatataagtttctcggggctaaacttggttacacttgaccccaatggaggcgtgggggtgcttggaggagtttgcggacgtgcgccgtttgctggacgagagctctaaccatacctatactatttggaggtatctgtggggctctactcaggccaagttggtctccagaattaagcaggattacaagtgcgattttgaagagctttttagttcctgcggtgagcttttgcaatccttgaatctgggccatcaggctattttccaggaaaaggttctctcgactttggatttttccactcccgggcgcaccgccgcttgtgtggcttttgtgtcttttgtgcaagataaatggagcgaggagacccacctgagtcacggctacgtactggatttcatggcgatggctctttggagggctcacaacaaatggaagattcagaaggaactgtacggttccgccctacgtcgtccacttttgtcgcgacaggggctgaggtttcccgaccatcggcagcatcagaatctggaagacgagtcggaggagcgagcggaggagaagatcagcttgagagccggcctggaccctcctcaggaggaatgaatctcccgcaggtggttgacctgtttccagaactgagacgggtcctgactatcagggaggatggtcagtttgtgaagaagtttaagagggatcggggtgagggagatgatgaggcggctagcaatttagcttttagtctgatgactcgccaccgaccggaatgtattacctatcagcagattaaggagagttgtgccaacgagctggatcttttgggtcagaagtatagcatagaacagcttaccacttactggcttcagcctggggatgattgggaagaggcgatcagggtgtatgcaaaggtggccctgcggcccgattgcaagtataagattactaagttggttaatattagaaactgctgctatatttctgggaacggggccgaagtggagatagatactcaggacagggtggcttttaggtgttgcatgataaacatgtggcccgggatactggggatggatggggtggtgttcatgaatgtgaggtttacgggccccaactttaatggcacggtgttcatgggcaacaccaacttgctcctgcatggtgcgagtttctatgggtttaataacacctgtatagaggcctggaccgatgtaaaggttcgaggttgttccttttatagctgttggaaggcggtggtgtgtcgccctaaaagcaggggttctgtgaaaaaatgcttgtttgaaaggtgcaccttaggcatcctctctgagggcaactccagggtgcgccataatgtggcttcgaactgcggttgcttcatgcaagtgaagggggtgagcgttatcaagcataactcggtgtgtggaaactgcgaggatcgcgcctcccagatgctgacctgctttgatggtaactgtcacctgttgaagaccattcatataagcagccaccccagaaaggcctggcccgtgtttgagcataacatcctgacccgctgctccttgcatctgggggtcaggaggggtatgttcctgccttaccagtgtaactttagccacactaaaatcctgctggaacccgagtgtatgaccaaggtcagcctaaatggcgtgtttgatgcgactctgagaatctggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgcaccagggccgagtttgggtctagcgatgaggataccgattgaggtgggtaaggtgggcgtggctagaagggtggggcgtgtataaattgggggtctaagggtctctctgttttgtcttgcaacagccgccgccatgagcgacaccggcaacagctttgatggaagcatctttagcccctatctgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcggcgcggcctctcgcgcgtctgctcgggatgagaaactgaccgctctgctgcttaaactggaagacttgacccgggagctggctcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataagacatctttacaaatcgggggcggagggtcccggactggggtatgatggtaccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagcctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcgccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtcctgaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaaggaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacgggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcctcctggagatctcctcgtccggcgcgctccacggtggccgccaggtcgttggagatgcgacccatgagctgcgagaaggcgttgagcccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacgccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcataaggcggtggtatccgtagatgtacctggacatccaggtgatgccggcggcggtggtggtggcgcgcgcgtagtcgcggacccggttccagatgtttcgcaggggcaagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgagggccgtggcagccccgtcctcaggaccccgccagccgacttctccagttacgggagcgagccccttttgtttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtgaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggacgatgaccaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgagtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggatgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttgaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggaaacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacgcaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcattaaccgcctgatggactacttgcatcgggcggcggccgtgaaccccgagtacttcactaatgccattctgaatccccactggatgccccctccgggtttctacaacggggacttcgaggtgcccgaggttaacgacgggttcctctgggatgacatggatgacagtgtgttctcacccaacccgctgcgcgccgcgtctctgcgattgaaggagggttctgacagggaaggaccgaggagtctggcctcctccctggctctgggagcggtgggcgcggcggcgcggggcagtagccccttccccagcctggcagactctctgaacagcgggcgggtgagcaggccccgcttgctaggcgaggaggagtatctgaacaactccctgctgcagcccgcgagggacaaaaacgctcagcggcagcagtttcccaacaatgggatagagagcctggtggacaagatgtccagatggaagacgtatgcgcaggagtacaaggagtgggaggaccgccagccgcggcccctgccgccccctaggcagcgctggcagcggcgcgcgtccaaccgccgctggaggcaggggcccgaggacgatgatgactctgcagatgacagcagcgtgctggacctgggcgggagcgggaaccccttttcgcacctgcgcccccgcctgggcaagatgttttaaaagagaaaaaataaaaactcaccaaggccatggcgacgagcgttggttttttgttcccttccttagtatgcgacgcgcggcgatgttcgaggaggggcctcccccctcttacgagagcgcgatgggattttctcctgcgacgcccctacagcctccctacgtgcctcctcggtacctgcaacctaccgggggaagaaatagcatctgttactctgagctgcagcccctgtatgacaccaccaaagtgtacctggtggacaacaagtctgcggacgtggcctccctgaactaccagaacgaccacagcgattttttgaccaccgtgatccaaaacaatgacttcaccccaaacgaggccagcacccagaccataaacctggacaacaggtcgcactggggcggtgatctgaagaccatcttgcacaccaacatgcccaacgtgaatgagtttatgtttactaactcttttaaggcgcgggtaatggtggcgcgcgacgataagggagtgcctaaatacgagtgggtggactttacactgcccgagggcaactactccgagatcatgactcttgacctgatgaacaacgcgatcgtggagcactacttgaaagtaggcaggcagaacggggtaaaagaaagcgatattggagttaagtttgacaccaggaactttcgcctgggatgggaccccgagacggggttggttatgcccggggtttacactaatgaagcttttcaccccgatatagtgctcttgcccggatgcggggtggacttcacccaaagccggctgagcaacctgctgggcattcgaaagcgccagccattccaggaggggtttcaaatcacttatgagcatttggaagggggcaacattccggcgcttctggatttggtcgcctacgaggagagtttgaaatccgaggaaagcggggataacactgacaagggcggcgaggagcaagccggcgatggcgacactgcttcggtagaaaacgaaagtgcgtccgtggtggaggcggcggcggtagcgaccgcagagccggagaccgtagaggaggatatgaatgatagcgcaatcagaggagactcgtttattccccggggcgaagaaaagaaggcggaggctgcggcagcagtcgaagcagagcccaaagtcgagtcggagatcatggaggaggatttgaatgataacgcgatcagaggtgatacgtttgtgccgcggggcgaagaaaaaaaagcggaggcggaggccgcggctgaggaggcggccgaggctgtggcagccaccgcggcggtgactgaaacaactgaggagcaggttcaggccgagcaggttcaaaagaagcccgtgattaaagccctaacacaagatagcaaggagcgcagttacaacttgattcccggtagtactgacaccgagtaccgcagctggtacctggcatacaactacggcgacccggtcaaaggggtgcgctcgtggactctgctttgcacgccggacgtcacctgcggctccgagcagatgtactggtcgttgccaaacatgatgcaagacccggtgaccttccgctccacgcggcaggttaacaacttcccggtggtgggcgccgaactgctgcccgtgcactccaagagcttttacaacgagcaggccgtgtactcccagctgatccgccaggccacctctctgacccacgtgttcaatcgctttcccgagaaccagattttggcgcgcccgccggcccccaccatcactaccgtcagtgaaaacgttcctgctctcacagatcacgggacgctaccgctgcgcaacagcatctcaggagtccagcgagtgaccattactgacgccagacgccggacctgcccctacgtttacaaggccttgggcatagtctcgccgcgcgtcctctccagccgcactttttaaaacacatattcacccacgcttcaaagattatgtctatacttatctcacccagcaataacaccggctgggggctgcgcgcgcccagcaagatgtttggaggggcgagaaaacgttccgagcagcacccagtgcgcgtgcgcggccactaccgcgcgccctggggagcgcacaagcgcgggcgcgcagggcgcaccactgtggacgacgccattgactccgtagtggagcaggcgcgccactacacacccggcgcgccgtccgcccccgccgtgtccaccgtggacgaggcgatcgaaagcgtggtacagggcgcgcggcactatgccaaccttaaaaatcgccgccgtcgcgtggcccgccgccatcgccggagaccccgggccaccgccgccgcgcgccttgctaaggctctactcaggcgcgccaggcgaactggccgccgggccgccatgagggccgcacggcgggctgccgccagtgcggccgccgcggccccacgggcacgaaggcgcgcggccgctgccgccgccgccgccatttccagcttggcctcaacgcggcgcggtaacatatactgggtgcgcgactcgataaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgatgacgaggcggtggagtttgtccgccgcatggcacccaggcgccccgtgcagtggaagggtcggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtgaccctgcaacaggtgctgcctttgagcgcgcccagcgagcataagcgagggttgaagcgcgagggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcagcggccagcgccaccaccggcaccgcttcggtagaggtgcagacggacccctggctacccgccgccgctgtcgccgccgccgccgccccccgttctcgcgggcgcaagagaaattatccagtggccagcgcgctcatgccccagtacgcactgcatccatccatcgcgcccacccccggctaccgcgggtattcgtaccgcccgcgcagatcggccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcatttttttggaggaaaaataaaaaagtctagactctcacgctcgcttggtcctgtgactattttgtagaaaaaagatggaagacatcaactttgcgtcgctggccccgcgtcatggctcgcgcccgttcatgggagactggacagatatcggcaccagcagtatgagcggtggcgccttcagctggggcagtctgtggagcggccttaaaaattttggttccaccattaaaaactatggcaacaaagcgtggaacagcagcacgggccagatgctaagagacaagttgaaagagcagaacttccaggagaaggtggcgcagggcctggcctctggcatcagcggggtggtggacatagctaaccaggccgtgcagaaaaagataaacagtcatctggacccccgccctcaggtggaggaaacgcctccagccatggagacggtgtttcccgagggcaaaggcgaaaagcgcccgcggcccgacagggaagagaccctggtgtcacacaccgaggagccgccctcttacgaggaggcactcaaggccggcctgcccaccactcgccccgtagctcccatggccacaggtgtggtgggccataaacaacacacccccgcaacactagatctgcccccgccgtccgagccgccgcgtcagccaaagacggcgacggtgcccgctccctccacttccgccgccaacagagtgtccctgcgccgcactacgggcgcccctcggggaccgcgactgagcggcaactggcagagcacactgaacagcattgtgggcctgggagtgaaaagtgtgaagcgccgccgttgctactgaatgagcaagctagctaacgtgttatatgtgtgtatgcgtcctatgtcgccgccagaggagctgttgagccgcccgcgccgtctgcactccagcgaatttcaagatggcgaccccttcgatgatgccacagtggtcgtacatgcacatctcgggccaggacgcctcggagtacctgagccccgggctggtgcagttcgcccgcgccaccgacagctacttcagcctaagtaacaaatttaggaaccctacggtggcacccacccacgatgtgaccacggaccggtcgcagcgcctgacgctgcggtttatccccgtggatcgggaggacactgcctactcttacaaggcgcgcttcacgctagccgtgggcgacaaccgcgtgctggacatggcctccacctactttgatatccggggtgtgctggacaggggtcccacctttaagccctactcgggcactgcctacaactccctggctcctaaaggcgctcccaattcttgcgagtgggatgaaaaaactaatactgctgaagcagccattgaaaatgaagaagagctggcggatgagccagaagagcaagcagaagaggctataaaaaccaatgtgtttgcccaggcgccatattctggcaatgcaatttccaaagaaggaatacaagtaggcatagaaggcattggagagcaagtaaaagccgtatacgcagacaaaacctaccagccggaacctcaggttggagaaactcaatggaatgagactgaaataaatcatggagcaggaagggtgctgaagaagaccactcccatgaagccttgctatggttcttatgctaaacctactaatgaatatggaggccagggcatccttgtagaaaaaaatggcaaaatggaaagccaggtggaaacacagttttttgctcttgacggtgaaaatgataatagtccaaaagtggtgttgtatagcgaagatgtaaacttggatactcctgacacacacctatcatacaaacctagcgcccaagatgtaaactctaaagaaatgttgggccaacaggccatgcccaacaggccaaatcttattgcttttagggacaactttattggacttatgtactacaacagcactggcaacatgggagtgctggcaggacaggcctcccaactaaatgccgtggtagacttgcaagacagaaacacagagttgtcataccagctgatgcttgattccattggagacagatcaagatattttgccatgtggaaccaggcggttgatagttacgatccagatgttagaattattgaaaaccatggcacagaggatgaacttccaaactactgttttcctttgggaggaatatttaatactcagagttttaaaaaggtaaaacctggaacggataacggatgggaaacagatgatgacttttcagataaaaatgaaataagagttggcaacaactttgccatggagatcaatatccaggcaaacctgtggagaagcttcttgtattccaatgtggctctctacctgccagataagatgaagtactctccaaccaacatagacatttccaccaacactaacacctatgactacatgaacaaaagagtggcgcctccaggcctggtggactgctatgtcaatctgggggccaggtggtcccttgatgtaatggataacatgaacccctttaaccaccaccgcaatgcgggcctgcgataccgttccatgcttctgggtaacggccgctacgtgcccttccacatccaggtgccccaaaagttctttgccatcaaaagccttctactcttgcctggctcgtacacctacgaatggaatttcagaaaggatgtgaacatggtcctacagagctctctgggcaacgaccttagggtggatggggccagcatcaagtttgacagcatcaccctttatgctacctttttccccatggcccacaacaccgcttccacgcttgaggccatgctcagaaacgacaccaacgaccagtccttcaatgactacctctctggggccaacatgctctaccccatccccgccaacgctaccaacgtgcccatctccattccctctcgcaactgggccgccttcagaggctgggcatttacccgccttaagaccaaggagaccccctccctgggctcgggttttgacccctactttgtctactcgggatccatcccctacctggatggcaccttctacctcaaccacacttttaagaagatatccatcatgtatgactcctctgtcagctggccgggcaacgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccgttggcatcactcaccagcacaacaactcgggattcgtgggctacctggcacccaccatgcgcgagggacaggcctaccccgccaacttcccctaccccttgataggcaagaccgcggtcgacagcgtcacccagaaaaagttcctctgcgaccgcaccctctggcgcatccccttttctagcaacttcatgtccatgggcgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacttgctacctctttgacccttttggcttctccgatcagcgcctcaagcagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcgcatccggggggccacctctttctgccacttgcaagaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggttcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattatgcacgctggccagcaggctctcgtcgctgatcatgtcgctgtccagatcctccgcgttgctcagggcgaatggggtcatcttgcagacctgcctgcccaggaaaggcggcagcccgggcttgccgttgcagtcgcagcgcaggggcatcagcaggtgcccgcggcccgactgcgcctgcgggtacagcgcgcgcatgaaggcttcgatctgcctgaaagccacctgcgccttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtcccgtgcagacacttcaggtcgccctccgtctgggtgcagcggtgctcccacagcgcgcaaccggtgggctcccaattcttgtgggtcacccccgcgtaggcctgcaggtaggcctgcaagaagcgccccatcatggccacgaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagcgccgcctgctcttcttcgtcttcgctgtctaccactatctctggggaagggcttctccgctctgcggcggtgcgcttcttttttttcttgggagcagccgtgacggagtccgccacggcgacggaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcctctcgagctggtcttggtctcgactggccattgtatcctcctcctcctaggcagagagacataaggagtctatcatgcaagtcgagaaggaggagagcttaaccaccccctctgacaccgccgatgcgcccgccgtcgccgtcgcccccgctgccgccgacgcgcccgccacaccgagcgacacccccgcggacccccccgccgacgcacccctgttcgaggaagcggccgtggagcaggacccgggctttgtctcggcagaggaggatttgcgagaggaggagaataaggagaagaagccctcagtgccaaaagatgataaagagcaagacgagcacgacgcagatgcacaccagggtgaagtcgggcggggggacggagggcatggcggcgccgactacctagacgaagggaacgacgtgctcttgaagcacctgcatcgtcagtgcgccatcgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgccttcgtggtgcccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtgccaaagatctttgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctaaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgcggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgtctggaggagcgcaacctcaaagagctggagaagctcctgcagcgcgcgctcaaagacctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaggaccaatcccgcccgcccaaggcggagctgaccgcctgcgtcatcacccagggcgagatcctaggccaattgcaagccatccaaaaagcccgccaagattttttgctgaagaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcgattaccaccacgccccgcaataatcccaaccccagggagtggcccgcgtccctggtgtatcaggaaattcccggccccaccaccgtactacttccgcgtgattcccaggccgaagtccaaatgactaactcaggggcgcagctcgcgggcggctgtcgtcacagggtgcggccccctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctccggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgagaaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgattttatagaaccccagtgcaatatcacttataaatctgaatataacctctgcactatcctaattaaatgcgttactcaacacgatgaggtaactgttagatacaaagatcaatcaaaaagagacgcactttacagcagctggcaaccaggagatgaacaaaaatacaatgtgaccgtcttccagggcaaactctccaaaacttacaattacactttcccattcgaggagatgtgtgagtttgtcatgttcatgtcaaagcagtacaagatgtggcctccgactccccagggctgtgtggaaaatccaggctctttctgcatgatctctctctgtgtaactgtgctggcactaatactcacgcttttgtatatcagatttaaatcaaggcaaagcttcatcgatgaaaagaaaatgccttaatcgcttttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatttaaccttgattgatgttcaattgctggatgcgggctactattatgggcagctgggtacaatcgttaattactggagaccccacaaagattacatgcttcacgtagtaaagggtccccttagcagcccgaccactaccaccacctctaccacacccactaccaccactactcccatcaccagcactgccacccagcctcctcatagcagaacaaccacttttatcaattccaagtcccactccccccacattgccggcgggccctccgcctcaaactccgagaccaccgagatctgcttctgcaaatgctctgacgccattgcccaggatttggaagaccacgaggaagatgagcatgacttcgcagatgcatgccaggcatcaggggcagaagcactgccggtggccctcaaacagtatgcagactcccataccacccccgatcttccaccgccttcccagaagccaagtttcctgggggaaaatgaaacactgcctctctccatacttgctttgacatctgttgctattctgactgctctgctggtgctcctatgctctatatgctacctgatctgctgcaggaagaaaaaatctcacggccatgctcaccagccgcttatgcacttcccttaccctccagagttgggcgaccacaaactttaagtctgcagtagctatctgcccatcccttgtcagtcgacagcgatgagccccactaatctaacggcctctggacttacaacattgtctcttaatgagaccaccgctcctcaagacctgtacgatggtgtctccgcgctggttaaccagtgggatcacctgggcatatggtggctcctcataggagcagtgaccctgtgcctaatcctggtctggataatctgctgcatcaaaagcagaagacccaggcggcggcccatctacaggcccttcgtcatcacacctgaagatgatgatggcaccacgtccaggctgcagagcctaaagcagctactcttctcttttacagcatggtaaattgaacatgcctcgcattttcatctacttgtttcttcttccactctttttgggctcttctacattggcagctgtgtcccacatcgaggtagactgcatctcgcccttctcagtctacttactcttcggctttgtcatttgcaactttgtctgcagcgttatcactgtagtgatctgcttcatacagtgcatcgactacgtctgcgtacgggtggcctattttagacaccacccccagtatcgcaacagggacatagcggctctcctaagacttgtttaaatcatgcccaaattaactgtgattgctcttctgattatctgctgcgtcctagccgcgattgggactcagcctactaccaccaccaccagcgctcccagaaagagacatgtttcctgcagcttcaaacgtccctggaatataccccaatgctttactgatgaacctgaaatctctttggcttggtacttcagcgtcaccgcccttctcatcttctgcagtacggttattgcccttgccatttacccttcccttgacctgggctggaatgctgtcaactctatggaatatcccaccttcccagaaccagacctgccagacctggttgttctaaacgcgtttcctcctcctcccgttcaaaatcagtttcgccctccgtccccgacgcccactgaggtcagctactttaatctaacaggcggagatgactgaaaacctagacctagaaatggacggcctctgcagcgaacaacgcatactagagaggcgccggcaaaaagcagagctcgagcgtcttaaacaagagctccaagacgcggtggccatacaccagtgcaaaaaaggtgtcttctgtctagtgaaacaggccacgctcacctatgaaaaaacaggtgacacccaccgcctaggatacaagctgcccacacaacgccagaagttcgcccttatgataggcgaacaacccatcaccgtcacccagcactctgtggagacagaaggctgcatacacgctccctgcaggggcgctgactgtctctacaccttgatcaaaaccctctgcggccttagagacctcatccctttcaattgatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtcccttttcccacccctccctttgtgtcccccgcaggaatgcaagaaaacccccctggagtgctatccctacgccttgcagaacccttgaccacctccaatggagcgctgaccctaaaaatggggggtggtttgaccctggacgaagaaggaaagcttacttcccaaaatattaccagtgttgatcctcctcttaaaaaaacaaaaaacaatatcagtctgcagactgcctccccccttgccgtcagctcgggagccctcacacttttcgctactcctcccctggcagttaatgacaataacctaactgtgcagtctcaggctccccttacactggaaaactcaaaactaagtctggccaccaaaggccccctaaccgtttctgaaggaaaacttgccctagaaacagaggctcccttgcatgcaagcgacagcagtagcctaggccttagtgtaacggccccactgagcattagcagcgacagcctaggactagacttgcaagcgcccattatttctgaaaatggaaaactgggcctaagagtaacaggtcccctaactgtggccagcagtattgatgctttgacagtagccacaggcagcggtattggacttgatagcaacacgcgcctacaggcaaaattggtcgcgcccctaggctttgacaccaatggcaacattaagctcagcacttcgggcggcatgagactgaacaatggcacacttatactagatgtaaactacccatttgaggctcaaggtcaacttagtctaagagtgggttcgggtccactgtatgtagactccaacacacataacctaaccgctagatgccttagagggctatacataacgtcatctaataaccaaaccggcctggaggccaacataaaacttacaaaaggacttgtgtttgatggaaatgccatagcagttaatgttagcaaagggctagaatacagtaccactgaaacagcgcagggtgtaaatcccatacagactaaaataggtttgggcatggaatatgataccaatggagccataaagccaagactaggctctggtttgagctttgataattcaggagctattgtagtgggaaacaaaaatgatgacactcttactctgtggactacaccagacccatctcccaactgtcagattaactcggaaaaagatgctaaactaaccttggtactaaccaagtgcggtagtcaaattgtaggcacagtatctgcctttgctcttaaaggcagccttgccccaattaatggcacagtgagctcagttagtatattcctaagatttaatgaaaatggggtactgatgagcaactcatcgttggaaagccaatactggaattacaggaatggaaattcaactaatgccacaccatatacaaatgcactaggttttatgcctaacctggcagcttatcccaaaggccaggcaacgactgcaaaaagcagcatcattagccaggtttacatgaatggtgacacttccaaacctatgatatttacaataacttttaatgggcttgaaacagaggaaactcaggtcagtacatattccatgacattttcatggaggtggacaaatggagactacgtggggcactattttaaaacaaactcctttactttctcctacattgcccaagaataaagaaagcacagagatgcttgtttttgatttcaaaattgtgtgcttttatttatttcaagcttacagtatttccagtagtcattcgaatagagcttaattaaactgcatgagaacccttccacatagcttaaattagcaccagtgcaaatggagaaaaatcaacatacctttttatccagatatcagagaactctagtggtcagttttcccccaccctcccagctcacagaatacacagtcctttccccccggctggctttaaacaacactatctcattggtaacagacatattcttaggtgtaataatccacacggtctcttggcgggccaaacgctggtcggtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgcagcaacaaggcgcgcagcaactcctgccgccgcctctccgtacggcaggaatgcaacggcgtggtggtctcctccgcgataatccgcaccgctcgcagcatcagcatcctcgtcctccgggcacagcagcgcatcctgatctcactgagatcggcgcagtaagtgcagcacaaaaccaagatgttatttaagatcccacagtgcaaagcgctgtacccaaagctcatggcgggaaggacagcccccacgtgaccatcataccagatcctcaggtaaatcaaatgacgacctctcataaacacgctggacatgtacatcacctccttgggcatgtgctgattcaccacctctcgataccacaagcatcgctgattaattaaagacccctcgagcaccatcctgaaccaggaagccagcacctgaccccccgccaggcactgcagggaccccggtgaatcgcagtggcagtgaagactccagcgctcgtagccgtgaaccatagagctggtcattatatccaaattggcacaacacagacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgttcggtgtagtagttgtaatacagccactccctgagaccgtcaaggcgctccctggcgtccggatctatgacaacaccgtcctgcagcgccgccctgatgacatccaccaccgtagagtatgccaagcccagccaggaaatgcattcactttgacagcgagagataggaggagcggggagagatggaagaaccatgatagtaaagagaacttttattccaatcgatcttctaagatatcaaagtggagatctataagatgacactggtctcctccgctgagtcgatcaaaaataacagctaaaccacaaacaacacgattggtcaaatgctccacaagggcctgcagcataaaattgcctcggaactccaccgcaagcataacatcaaagccaccgcctctatcgtgatcaagaataaaaaccccacagctatccaccagacccatatagttttcatctctccatcgtgaaaaaagatttacaagctcctcctttaaatcacctccaaccaattgaaaaagttgaaccagaccgccctccaccttcattttcagcaagcgtatcatgattgcaaaaattcaggctcctcagacacctgtataagattgagaagcggaacgttaacatcgatgtttcgctcgcgtaaatcacgcctcagtgcaagcataatataatcccacaggtcggagcggatcagcgaggacacctccccgccaggaaccaactcaacggagcctatgctgattataatacgcatattcggagctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacgaccacagaaaaatgcacaatttttctctcaaacatgactgcgagccctgcaaaaaataaaaaagaaacattacacaagagtagcctgtcttacgatgggatagactactctaaccaacataagacgggccacaacatcgcccgcgtggccataaaaaaaattgtccgtgtgattaaaaagaagcacagatagctggccagtcatatccggagtcatcacgtgtgaacccgtgtagacccccgggttggacacatcggccaaagaaagaaagcggccaatgtacccaggaggaattataacactaagacgaagatacaacagaataaccccatgagggggaataacaaagttagtaggtgaataaaaacgataaacacccgaaactccctcctgcgtaggcaaaatagcaccctccccttccaaaacaacatatagcgcttccacagcagccatgacaaaagactcaaaacactcaaaagactcagtcttaccaggaaaataaaagcactctcacagcaccagcactaatcagagtgtgaaaagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccgctttctcacgatacgtcacttccgcaagaaaagcaaaactacatttcccacatgtgtaaaaacgaaaccccgccccttctaaccgcccacaacttacatcatcaaaacgtaaagtcctacgtcacccgccccgcctctccccgcccacctcattatcatattggccacaatccaaaataaggtatattattgatgatg

SEQ ID NO: 18 - DNA, 37074 bp, Gorilla beringei graueri
catcatcaataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcaccgtcatttgacgcggagggtatttaaacccgctgcgctcctcaagaggccactcttgagtgccagcgagaagagttttctcctctgctccgcttcggtgatcgaaaaatgagacacatagcctgcactccgggtcttttgtccggtcgggcggcggccgagcttttggacgctttgatcaatgatgtcctgagcgatgattttccgtctactacccactttagcccacctactcttcacgaactgtacgatctggatgtactggtggatgtgaacgatcccaacgaggaggcggtttctgcgttttttcccgagtctgcgctgttggccgctcaggagggatttgacctacacactccgccgcctattttagagtctccgctgccggagcccagtggtataccttatatgcctgaactgcttcccgaagtggtagacctgacctgccacgagcctggctttccgcccagcgacgatgatggtgagccttttgttttagactttgctgagatacctgggcacggttgcaggtcttgtgcatatcatcagagggttaccggagaccccgaggttaagtgttcgctgtgctatatgaggatgacctcttcctttatctacagtaagtttttgtctaggtgggcttttgggtaggtgggttttgtgtcagaacaggtgtaaacgttgcttgtgttttttgtacctgtaggtccggtgtccgagccagacccggagcccgaccgcgatcccgagccggatcccgagcctcctcgcaggacaaggaaactaccttccattctgtgcaagtctcagacacctgtaaggaccagcgaggcagacagcaccgactctggcacttctacctctccccctgaaattcacccagtggttcctctgggtatacataaacctgttgctgttagagtttgcgggcgacgccctgcagtacagtgcattgaggacttgcttcacgatcccgaggaacctttggacttgagccttaaacgccctaggcaataaaccccacctaagtaataaaccccacctaagtaataaaccctgccgcccttggttattgagatgacgcccaatgtttgcttttgaatgacttcatgtgtgtaataaaagtgagtgtgatcataggtctcttgtttgtctgggcggggcttaagggtatataagtttctcggggctaaacttggttacacttgaccccaatggaggcgtgggggtgcttggaggagtttgcggacgtgcgccgtttgctggacgagagctctaaccatacctatactatttggaggtatctgtggggctctactcaggccaagttggtctccagaattaagcaggattacaagtgcgattttgaagagctttttagttcctgcggtgagcttttgcaatccttgaatctgggccatcaggctattttccaggaaaaggttctctcgactttggatttttccactcccgggcgcaccgccgcttgtgtggcttttgtgtcttttgtgcaagataaatggagcgaggagacccacctgagtcacggctacgtactggatttcatggcgatggctctttggagggctcacaacaaatggaagattcagaaggaactgtacggttccgccctacgtcgtccacttttgtcgcgacaggggctgaggtttcccgaccatcggcagcatcagaatctggaagacgagtcggaggagcgagcggaggagaagatcagcttgagagccggcctggaccctcctcaggaggaatgaatctcccgcaggtggttgacctgtttccagaactgagacgggtcctgactatcagggaggatggtcagtttgtgaagaagtttaagagggatcggggtgagggagatgatgaggcggctagcaatttagcttttagtctgatgactcgccaccgaccggaatgtattacctatcagcagattaaggagagttgtgccaacgagctggatcttttgggtcagaagtatagcatagaacagcttaccacttactggcttcagcctggggatgattgggaagaggcgatcagggtgtatgcaaaggtggccctgcggcccgattgcaagtataagattactaagttggttaatattagaaactgctgctatatttctgggaacggggccgaagtggagatagatactcaggacagggtggcttttaggtgttgcatgataaacatgtggcccgggatactggggatggatggggtggtgttcatgaatgtgaggtttacgggccccaactttaatggcacggtgttcatgggcaacaccaacttgctcctgcatggtgcgagtttctatgggtttaataacacctgtatagaggcctggaccgatgtaaaggttcgaggttgttccttttatagctgttggaaggcggtggtgtgtcgccctaaaagcaggggttctgtgaaaaaatgcttgtttgaaaggtgcaccttaggcatcctctctgagggcaactccagggtgcgccataatgtggcttcgaactgcggttgcttcatgcaagtgaagggggtgagcgttatcaagcataactcggtgtgtggaaactgcgaggatcgcgcctcccagatgctgacctgctttgatggtaactgtcacctgttgaagaccattcatataagcagccaccccagaaaggcctggcccgtgtttgagcataacatcctgacccgctgctccttgcatctgggggtcaggaggggtatgttcctgccttaccagtgtaactttagccacactaaaatcctgctggaacccgagtgtatgaccaaggtcagcctaaatggcgtgtttgatgcgactctgagaatctggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgcaccagggccgagtttgggtctagcgatgaggataccgattgaggtgggtaaggtgggcgtggctagaagggtggggcgtgtataaattgggggtctaagggtctctctgttttgtcttgcaacagccgccgccatgagcgacaccggcaacagctttgatggaagcatctttagcccctatctgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcggcgcggcctctcgcgcgtctgctcgggatgagaaactgaccgctctgctgcttaaactggaagacttgacccgggagctggctcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataagacatctttacaaatcgggggcggagggtcccggactggggtatgatggtaccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagcctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcgccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtcctgaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaaggaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacgggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcctcctggagatctcctcgtccggcgcgctccacggtggccgccaggtcgttggagatgcgacccatgagctgcgagaaggcgttgagcccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacgccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcataaggcggtggtatccgtagatgtacctggacatccaggtgatgccggcggcggtggtggtggcgcgcgcgtagtcgcggacccggttccagatgtttcgcaggggcaagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgagggccgtggcagccccgtcctcaggaccccgccagccgacttctccagttacgggagcgagccccttttgtttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtgaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggacgatgaccaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgagtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggatgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttgaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggaaacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacgcaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcattaaccgcctgatggactacttgcatcgggcggcggccgtgaaccccgagtacttcactaatgccattctgaatccccactggatgccccctccgggtttctacaacggggacttcgaggtgcccgaggttaacgacgggttcctctgggatgacatggatgacagtgtgttctcacccaacccgctgcgcgccgcgtctctgcgattgaaggagggttctgacagggaaggaccgaggagtctggcctcctccctggctctgggagcggtgggcgcggcggcgcggggcagtagccccttccccagcctggcagactctctgaacagcgggcgggtgagcaggccccgcttgctaggcgaggaggagtatctgaacaactccctgctgcagcccgcgagggacaaaaacgctcagcggcagcagtttcccaacaatgggatagagagcctggtggacaagatgtccagatggaagacgtatgcgcaggagtacaaggagtgggaggaccgccagccgcggcccctgccgccccctaggcagcgctggcagcggcgcgcgtccaaccgccgctggaggcaggggcccgaggacgatgatgactctgcagatgacagcagcgtgctggacctgggcgggagcgggaaccccttttcgcacctgcgcccccgcctgggcaagatgttttaaaagagaaaaaataaaaactcaccaaggccatggcgacgagcgttggttttttgttcccttccttagtatgcgacgcgcggcgatgttcgaggaggggcctcccccctcttacgagagcgcgatgggattttctcctgcgacgcccctacagcctccctacgtgcctcctcggtacctgcaacctaccgggggaagaaatagcatctgttactctgagctgcagcccctgtatgacaccaccaaagtgtacctggtggacaacaagtctgcggacgtggcctccctgaactaccagaacgaccacagcgattttttgaccaccgtgatccaaaacaatgacttcaccccaaacgaggccagcacccagaccataaacctggacaacaggtcgcactggggcggtgatctgaagaccatcttgcacaccaacatgcccaacgtgaatgagtttatgtttactaactcttttaaggcgcgggtaatggtggcgcgcgacgataagggagtgcctaaatacgagtgggtggactttacactgcccgagggcaactactccgagatcatgactcttgacctgatgaacaacgcgatcgtggagcactacttgaaagtaggcaggcagaacggggtaaaagaaagcgatattggagttaagtttgacaccaggaactttcgcctgggatgggaccccgagacggggttggttatgcccggggtttacactaatgaagcttttcaccccgatatagtgctcttgcccggatgcggggtggacttcacccaaagccggctgagcaacctgctgggcattcgaaagcgccagccattccaggaggggtttcaaatcacttatgagcatttggaagggggcaacattccggcgcttctggatttggtcgcctacgaggagagtttgaaatccgaggaaagcggggataacactgacaagggcggcgaggagcaagccggcgatggcgacactgcttcggtagaaaacgaaagtgcgtccgtggtggaggcggcggcggtagcgaccgcagagccggagaccgtagaggaggatatgaatgatagcgcaatcagaggagactcgtttattccccggggcgaagaaaagaaggcggaggctgcggcagcagtcgaagcagagcccaaagtcgagtcggagatcatggaggaggatttgaatgataacgcgatcagaggtgatacgtttgtgccgcggggcgaagaaaaaaaagcggaggcggaggccgcggctgaggaggcggccgaggctgtggcagccaccgcggcggtgactgaaacaactgaggagcaggttcaggccgagcaggttcaaaagaagcccgtgattaaagccctaacacaagatagcaaggagcgcagttacaacttgattcccggtagtactgacaccgagtaccgcagctggtacctggcatacaactacggcgacccggtcaaaggggtgcgctcgtggactctgctttgcacgccggacgtcacctgcggctccgagcagatgtactggtcgttgccaaacatgatgcaagacccggtgaccttccgctccacgcggcaggttaacaacttcccggtggtgggcgccgaactgctgcccgtgcactccaagagcttttacaacgagcaggccgtgtactcccagctgatccgccaggccacctctctgacccacgtgttcaatcgctttcccgagaaccagattttggcgcgcccgccggcccccaccatcactaccgtcagtgaaaacgttcctgctctcacagatcacgggacgctaccgctgcgcaacagcatctcaggagtccagcgagtgaccattactgacgccagacgccggacctgcccctacgtttacaaggccttgggcatagtctcgccgcgcgtcctctccagccgcactttttaaaacacatattcacccacgcttcaaagattatgtctatacttatctcacccagcaataacaccggctgggggctgcgcgcgcccagcaagatgtttggaggggcgagaaaacgttccgagcagcacccagtgcgcgtgcgcggccactaccgcgcgccctggggagcgcacaagcgcgggcgcgcagggcgcaccactgtggacgacgccattgactccgtagtggagcaggcgcgccactacacacccggcgcgccgtccgcccccgccgtgtccaccgtggacgaggcgatcgaaagcgtggtacagggcgcgcggcactatgccaaccttaaaaatcgccgccgtcgcgtggcccgccgccatcgccggagaccccgggccaccgccgccgcgcgccttgctaaggctctactcaggcgcgccaggcgaactggccgccgggccgccatgagggccgcacggcgggctgccgccagtgcggccgccgcggccccacgggcacgaaggcgcgcggccgctgccgccgccgccgccatttccagcttggcctcaacgcggcgcggtaacatatactgggtgcgcgactcgataaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgatgacgaggcggtggagtttgtccgccgcatggcacccaggcgccccgtgcagtggaagggtcggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtgaccctgcaacaggtgctgcctttgagcgcgcccagcgagcataagcgagggttgaagcgcgagggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcagcggccagcgccaccaccggcaccgcttcggtagaggtgcagacggacccctggctacccgccgccgctgtcgccgccgccgccgccccccgttctcgcgggcgcaagagaaattatccagtggccagcgcgctcatgccccagtacgcactgcatccatccatcgcgcccacccccggctaccgcgggtattcgtaccgcccgcgcagatcggccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcatttttttggaggaaaaaataaaaaagtctagactctcacgctcgcttggtcctgtgactattttgtagaaaaaagatggaagacatcaactttgcgtcgctggccccgcgtcatggctcgcgcccgttcatgggagactggacagatatcggcaccagcagtatgagcggtggcgccttcagctggggcagtctgtggagcggccttaaaaattttggttccaccattaaaaactatggcaacaaagcgtggaacagcagcacgggccagatgctaagagacaagttgaaagagcagaacttccaggagaaggtggcgcagggcctggcctctggcatcagcggggtggtggacatagctaaccaggccgtgcagaaaaagataaacagtcatctggacccccgccctcaggtggaggaaacgcctccagccatggagacggtgtttcccgagggcaaaggcgaaaagcgcccgcggcccgacagggaagagaccctggtgtcacacaccgaggagccgccctcttacgaggaggcactcaaggccggcctgcccaccactcgccccgtagctcccatggccacaggtgtggtgggccataaacaacacacccccgcaacactagatctgcccccgccgtccgagccgccgcgtcagccaaagacggcgacggtgcccgctccctccacttccgccgccaacagagtgtccctgcgccgcactacgggcgcccctcggggaccgcgactgagcggcaactggcagagcacactgaacagcattgtgggcctgggagtgaaaagtgtgaagcgccgccgttgctactgaatgagcaagctagctaacgtgttatatgtgtgtatgcgtcctatgtcgccgccagaggagctgttgagccgcccgcgccgtctgcactccagcgaatttcaagatggcgaccccttcgatgatgccacagtggtcgtacatgcacatctcgggccaggacgcctcggagtacctgagccccgggctggtgcagttcgcccgcgccaccgacagctacttcagcctaagtaacaaatttaggaaccctacggtggcacccacccacgatgtgaccacggaccggtcgcagcgcctgacgctgcggtttatccccgtggatcgggaggacactgcctactcttacaaggcgcgcttcacgctagccgtgggcgacaaccgcgtgctggacatggcctccacctactttgatatccggggtgtgctggacaggggtcccacctttaagccctactcgggcactgcctacaactccctggctcctaaaggcgctcccaattcttgcgagtgggatgaaaaaactaatactgctgaagcagccattgaaaatgaagaagagctggcggatgagccagaagagcaagcagaagaggctataaaaaccaatgtgtttgcccaggcgccatattctggcaatgcaatttccaaagaaggaatacaagtaggcatagaaggcattggagagcaagtaaaagccgtatacgcagacaaaacctaccagccggaacctcaggttggagaaactcaatggaatgagactgaaataaatcatggagcaggaagggtgctgaagaagaccactcccatgaagccttgctatggttcttatgctaaacctactaatgaatatggaggccagggcatccttgtagaaaaaaatggcaaaatggaaagccaggtggaaacacagttttttgctcttgacggtgaaaatgataatagtccaaaagtggtgttgtatagcgaagatgtaaacttggatactcctgacacacacctatcatacaaacctagcgcccaagatgtaaactctaaagaaatgttgggccaacaggccatgcccaacaggccaaatcttattgcttttagggacaactttattggacttatgtactacaacagcactggcaacatgggagtgctggcaggacaggcctcccaactaaatgccgtggtagacttgcaagacagaaacacagagttgtcataccagctgatgcttgattccattggagacagatcaagatattttgccatgtggaaccaggcggttgatagttacgatccagatgttagaattattgaaaaccatggcacagaggatgaacttccaaactactgttttcctttgggaggaatatttaatactcagagttttaaaaaggtaaaacctggaacggataacggatgggaaacagatgatgacttttcagataaaaatgaaataagagttggcaacaactttgccatggagatcaatatccaggcaaacctgtggagaagcttcttgtattccaatgtggctctctacctgccagataagatgaagtactctccaaccaacatagacatttccaccaacactaacacctatgactacatgaacaaaagagtggcgcctccaggcctggtggactgctatgtcaatctgggggccaggtggtcccttgatgtaatggataacatgaacccctttaaccaccaccgcaatgcgggcctgcgataccgttccatgcttctgggtaacggccgctacgtgcccttccacatccaggtgccccaaaagttctttgccatcaaaagccttctactcttgcctggctcgtacacctacgaatggaatttcagaaaggatgtgaacatggtcctacagagctctctgggcaacgaccttagggtggatggggccagcatcaagtttgacagcatcaccctttatgctacctttttccccatggcccacaacaccgcttccacgcttgaggccatgctcagaaacgacaccaacgaccagtccttcaatgactacctctctggggccaacatgctctaccccatccccgccaacgctaccaacgtgcccatctccattccctctcgcaactgggccgccttcagaggctgggcatttacccgccttaagaccaaggagaccccctccctgggctcgggttttgacccctactttgtctactcgggatccatcccctacctggatggcaccttctacctcaaccacacttttaagaagatatccatcatgtatgactcctctgtcagctggccgggcaacgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccgttggcatcactcaccagcacaacaactcgggattcgtgggctacctggcacccaccatgcgcgagggacaggcctaccccgccaacttcccctaccccttgataggcaagaccgcggtcgacagcgtcacccagaaaaagttcctctgcgaccgcaccctctggcgcatccccttttctagcaacttcatgtccatgggcgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacttgctacctctttgacccttttggcttctccgatcagcgcctcaagcagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcgcatccggggggccacctctttctgccacttgcaagaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggttcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattatgcacgctggccagcaggctctcgtcgctgatcatgtcgctgtccagatcctccgcgttgctcagggcgaatggggtcatcttgcagacctgcctgcccaggaaaggcggcagcccgggcttgccgttgcagtcgcagcgcaggggcatcagcaggtgcccgcggcccgactgcgcctgcgggtacagcgcgcgcatgaaggcttcgatctgcctgaaagccacctgcgccttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtcccgtgcagacacttcaggtcgccctccgtctgggtgcagcggtgctcccacagcgcgcaaccggtgggctcccaattcttgtgggtcacccccgcgtaggcctgcaggtaggcctgcaagaagcgccccatcatggccacgaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagcgccgcctgctcttcttcgtcttcgctgtctaccactatctctggggaagggcttctccgctctgcggcggtgcgcttcttttttttcttgggagcagccgtgacggagtccgccacggcgacggaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcctctcgagctggtcttggtctcgactggccattgtatcctcctcctcctaggcagagagacataaggagtctatcatgcaagtcgagaaggaggagagcttaaccaccccctctgacaccgccgatgcgcccgccgtcgccgtcgcccccgctgccgccgacgcgcccgccacaccgagcgacacccccgcggacccccccgccgacgcacccctgttcgaggaagcggccgtggagcaggacccgggctttgtctcggcagaggaggatttgcgagaggaggagaataaggagaagaagccctcagtgccaaaagatgataaagagcaagacgagcacgacgcagatgcacaccagggtgaagtcgggcggggggacggagggcatggcggcgccgactacctagacgaagggaacgacgtgctcttgaagcacctgcatcgtcagtgcgccatcgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgccttcgtggtgcccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtgccaaagatctttgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctaaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgcggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgtctggaggagcgcaacctcaaagagctggagaagctcctgcagcgcgcgctcaaagacctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaggaccaatcccgcccgcccaaggcggagctgaccgcctgcgtcatcacccagggcgagatcctaggccaattgcaagccatccaaaaagcccgccaagattttttgctgaagaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcgattaccaccacgccccgcaataatcccaaccccagggagtggcccgcgtccctggtgtatcaggaaattcccggccccaccaccgtactacttccgcgtgattcccaggccgaagtccaaatgactaactcaggggcgcagctcgcgggcggctgtcgtcacagggtgcggccccctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctccggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgagaaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgattttatagaaccccagtgcaatatcacttataaatctgaatataacctctgcactatcctaattaaatgcgttactcaacacgatgaggtaactgttagatacaaagatcaatcaaaaagagacgcactttacagcagctggcaaccaggagatgaacaaaaatacaatgtgaccgtcttccagggcaaactctccaaaacttacaattacactttcccattcgaggagatgtgtgagtttgtcatgttcatgtcaaagcagtacaagatgtggcctccgactccccagggctgtgtggaaaatccaggctctttctgcatgatctctctctgtgtaactgtgctggcactaatactcacgcttttgtatatcagatttaaatcaaggcaaagcttcatcgatgaaaagaaaatgccttaatcgcttttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatttaaccttgattgatgttcaattgctggatgcgggctactattatgggcagctgggtacaatcgttaattactggagaccccacaaagattacatgcttcacgtagtaaagggtccccttagcagcccgaccactaccaccacctctaccacacccactaccaccactactcccatcaccagcactgccacccagcctcctcatagcagaacaaccacttttatcaattccaagtcccactccccccacattgccggcgggccctccgcctcaaactccgagaccaccgagatctgcttctgcaaatgctctgacgccattgcccaggatttggaagaccacgaggaagatgagcatgacttcgcagatgcatgccaggcatcaggggcagaagcactgccggtggccctcaaacagtatgcagactcccataccacccccgatcttccaccgccttcccagaagccaagtttcctgggggaaaatgaaacactgcctctctccatacttgctttgacatctgttgctattctgactgctctgctggtgctcctatgctctatatgctacctgatctgctgcaggaagaaaaaatctcacggccatgctcaccagccgcttatgcacttcccttaccctccagagttgggcgaccacaaactttaagtctgcagtagctatctgcccatcccttgtcagtcgacagcgatgagccccactaatctaacggcctctggacttacaacattgtctcttaatgagaccaccgctcctcaagacctgtacgatggtgtctccgcgctggttaaccagtgggatcacctgggcatatggtggctcctcataggagcagtgaccctgtgcctaatcctggtctggataatctgctgcatcaaaagcagaagacccaggcggcggcccatctacaggcccttcgtcatcacacctgaagatgatgatggcaccacgtccaggctgcagagcctaaagcagctactcttctcttttacagcatggtaaattgaacatgcctcgcattttcatctacttgtttcttcttccactctttttgggctcttctacattggcagctgtgtcccacatcgaggtagactgcatctcgcccttctcagtctacttactcttcggctttgtcatttgcaactttgtctgcagcgttatcactgtagtgatctgcttcatacagtgcatcgactacgtctgcgtacgggtggcctattttagacaccacccccagtatcgcaacagggacatagcggctctcctaagacttgtttaaatcatgcccaaattaactgtgattgctcttctgattatctgctgcgtcctagccgcgattgggactcagcctactaccaccaccaccagcgctcccagaaagagacatgtttcctgcagcttcaaacgtccctggaatataccccaatgctttactgatgaacctgaaatctctttggcttggtacttcagcgtcaccgcccttctcatcttctgcagtacggttattgcccttgccatttacccttcccttgacctgggctggaatgctgtcaactctatggaatatcccaccttcccagaaccagacctgccagacctggttgttctaaacgcgtttcctcctcctcccgttcaaaatcagtttcgccctccgtccccgacgcccactgaggtcagctactttaatctaacaggcggagatgactgaaaacctagacctagaaatggacggcctctgcagcgaacaacgcatactagagaggcgccggcaaaaagcagagctcgagcgtcttaaacaagagctccaagacgcggtggccatacaccagtgcaaaaaaggtgtcttctgtctagtgaaacaggccacgctcacctatgaaaaaacaggtgacacccaccgcctaggatacaagctgcccacacaacgccagaagttcgcccttatgataggcgaacaacccatcaccgtcacccagcactctgtggagacagaaggctgcatacacgctccctgcaggggcgctgactgtctctacaccttgatcaaaaccctctgcggccttagagacctcatccctttcaattgatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtcccttttcccacccctccctttgtgtcccccgcaggaatgcaagaaaacccccctggagtgctatccctacgccttgcagaacccttgaccacctccaatggagcgctgaccctaaaaatggggggtggtttgaccctggacgaagaaggaaagcttacttcccaaaatattaccagtgttgatcctcctcttaaaaaaacaaaaaacaatatcagtctgcagactgcctccccccttgccgtcagctcgggagccctcacacttttcgctactcctcccctggcagttaatgacaataacctaactgtgcagtctcaggctccccttacactggaaaactcaaaactaagtctggccaccaaaggccccctaaccgtttctgaaggaaaacttgccctagaaacagaggctcccttgcatgcaagcgacagcagtagcctaggccttagtgtaacggccccactgagcattagcagcgacagcctaggactagacttgcaagcgcccattatttctgaaaatggaaaactgggcctaagagtaacaggtcccctaactgtggccagcagtattgatgctttgacagtagccacaggcagcggtattggacttgatagcaacacgcgcctacaggcaaaattggtcgcgcccctaggctttgacaccaatggcaacattaagctcagcacttcgggcggcatgagactgaacaatggcacacttatactagatgtaaactacccatttgaggctcaaggtcaacttagtctaagagtgggttcgggtccactgtatgtagactccaacacacataacctaaccgctagatgccttagagggctatacataacgtcatctaataaccaaaccggcctggaggccaacataaaacttacaaaaggacttgtgtttgatggaaatgccatagcagttaatgttagcaaagggctagaatacagtaccactgaaacagcgcagggtgtaaatcccatacagactaaaataggtttgggcatggaatatgataccaatggagccataaagccaagactaggctctggtttgagctttgataattcaggagctattgtagtgggaaacaaaaatgatgacactcttactctgtggactacaccagacccatctcccaactgtcagattaactcggaaaaagatgctaaactaaccttggtactaaccaagtgcggtagtcaaattgtaggcacagtatctgcctttgctcttaaaggcagccttgccccaattaatggcacagtgagctcagttagtatattcctaagatttaatgaaaatggggtactgatgagcaactcatcgttggaaagccaatactggaattacaggaatggaaattcaactaatgccacaccatatacaaatgcactaggttttatgcctaacctggcagcttatcccaaaggccaggcaacgactgcaaaaagcagcatcattagccaggtttacatgaatggtgacacttccaaacctatgatatttacaataacttttaatgggcttgaaacagaggaaactcaggtcagtacatattccatgacattttcatggaggtggacaaatggagactacgtggggcactattttaaaacaaactcctttactttctcctacattgcccaagaataaagaaagcacagagatgcttgtttttgatttcaaaattgtgtgcttttatttatttcaagcttacagtatttccagtagtcattcgaatagagcttaattaaactgcatgagaacccttccacatagcttaaattagcaccagtgcaaatggagaaaaatcaacatacctttttatccagatatcagagaactctagtggtcagttttcccccaccctcccagctcacagaatacacagtcctttccccccggctggctttaaacaacactatctcattggtaacagacatattcttaggtgtaataatccacacggtctcttggcgggccaaacgctggtcggtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgcagcaacaaggcgcgcagcaactcctgccgccgcctctccgtacggcaggaatgcaacggcgtggtggtctcctccgcgataatccgcaccgctcgcagcatcagcatcctcgtcctccgggcacagcagcgcatcctgatctcactgagatcggcgcagtaagtgcagcacaaaaccaagatgttatttaagatcccacagtgcaaagcgctgtacccaaagctcatggcgggaaggacagcccccacgtgaccatcataccagatcctcaggtaaatcaaatgacgacctctcataaacacgctggacatgtacatcacctccttgggcatgtgctgattcaccacctctcgataccacaagcatcgctgattaattaaagacccctcgagcaccatcctgaaccaggaagccagcacctgaccccccgccaggcactgcagggaccccggtgaatcgcagtggcagtgaagactccagcgctcgtagccgtgaaccatagagctggtcattatatccaaattggcacaacacagacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgttcggtgtagtagttgtaatacagccactccctgagaccgtcaaggcgctccctggcgtccggatctatgacaacaccgtcctgcagcgccgccctgatgacatccaccaccgtagagtatgccaagcccagccaggaaatgcattcactttgacagcgagagataggaggagcggggagagatggaagaaccatgatagtaaagagaacttttattccaatcgatcttctaagatatcaaagtggagatctataagatgacactggtctcctccgctgagtcgatcaaaaataacagctaaaccacaaacaacacgattggtcaaatgctccacaagggcctgcagcataaaattgcctcggaactccaccgcaagcataacatcaaagccaccgcctctatcgtgatcaagaataaaaaccccacagctatccaccagacccatatagttttcatctctccatcgtgaaaaaagatttacaagctcctcctttaaatcacctccaaccaattgaaaaagttgaaccagaccgccctccaccttcattttcagcaagcgtatcatgattgcaaaaattcaggctcctcagacacctgtataagattgagaagcggaacgttaacatcgatgtttcgctcgcgtaaatcacgcctcagtgcaagcataatataatcccacaggtcggagcggatcagcgaggacacctccccgccaggaaccaactcaacggagcctatgctgattataatacgcatattcggagctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacgaccacagaaaaatgcacaatttttctctcaaacatgactgcgagccctgcaaaaaataaaaaagaaacattacacaagagtagcctgtcttacgatgggatagactactctaaccaacataagacgggccacaacatcgcccgcgtggccataaaaaaaattgtccgtgtgattaaaaagaagcacagatagctggccagtcatatccggagtcatcacgtgtgaacccgtgtagacccccgggttggacacatcggccaaagaaagaaagcggccaatgtacccaggaggaattataacactaagacgaagatacaacagaataaccccatgagggggaataacaaagttagtaggtgaataaaaacgataaacacccgaaactccctcctgcgtaggcaaaatagcaccctccccttccaaaacaacatatagcgcttccacagcagccatgacaaaagactcaaaacactcaaaagactcagtcttaccaggaaaataaaagcactctcacagcaccagcactaatcagagtgtgaaaagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccgctttctcacgatacgtcacttccgcaagaaaagcaaaactacatttcccacatgtgtaaaaacgaaaccccgccccttctaaccgcccacaacttacatcatcaaaacgtaaagtcctacgtcacccgccccgcctctccccgcccacctcattatcatattggccacaatccaaaataaggtatattattgatgatg

SEQ ID NO: 19 - DNA, 37057 bp, Gorilla beringei graueri
ataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcaccgtcatttgacgcggagggtatttaaacccgctgcgctcctcaagaggccactcttgagtgccagcgagaagagttttctcctctgctccgcttcggtgatcgaaaaatgagacacatagcctgcactccgggtcttttgtccggtcgggcggcggccgagcttttggacgctttgatcaatgatgtcctgagcgatgattttccgtctactacccactttagcccacctactcttcacgaactgtacgatctggatgtactggtggatgtgaacgatcccaacgaggaggcggtttctgcgttttttcccgagtctgcgctgttggccgctcaggagggatttgacctacacactccgccgcctattttagagtctccgctgccggagcccagtggtataccttatatgcctgaactgcttcccgaagtggtagacctgacctgccacgagcctggctttccgcccagcgacgatgatggtgagccttttgttttagactttgctgagatacctgggcacggttgcaggtcttgtgcatatcatcagagggttaccggagaccccgaggttaagtgttcgctgtgctatatgaggatgacctcttcctttatctacagtaagtttttgtctaggtgggcttttgggtaggtgggttttgtgtcagaacaggtgtaaacgttgcttgtgttttttgtacctgtaggtccggtgtccgagccagacccggagcccgaccgcgatcccgagccggatcccgagcctcctcgcaggacaaggaaactaccttccattctgtgcaagtctcagacacctgtaaggaccagcgaggcagacagcaccgactctggcacttctacctctccccctgaaattcacccagtggttcctctgggtatacataaacctgttgctgttagagtttgcgggcgacgccctgcagtacagtgcattgaggacttgcttcacgatcccgaggaacctttggacttgagccttaaacgccctaggcaataaaccccacctaagtaataaaccccacctaagtaataaaccctgccgcccttggttattgagatgacgcccaatgtttgcttttgaatgacttcatgtgtgtaataaaagtgagtgtgatcataggtctcttgtttgtctgggcggggcttaagggtatataagtttctcggggctaaacttggttacacttgaccccaatggaggcgtgggggtgcttggaggagtttgcggacgtgcgccgtttgctggacgagagctctaaccatacctatactatttggaggtatctgtggggctctactcaggccaagttggtctccagaattaagcaggattacaagtgcgattttgaagagctttttagttcctgcggtgagcttttgcaatccttgaatctgggccatcaggctattttccaggaaaaggttctctcgactttggatttttccactcccgggcgcaccgccgcttgtgtggcttttgtgtcttttgtgcaagataaatggagcgaggagacccacctgagtcacggctacgtactggatttcatggcgatggctctttggagggctcacaacaaatggaagattcagaaggaactgtacggttccgccctacgtcgtccacttttgtcgcgacaggggctgaggtttcccgaccatcggcagcatcagaatctggaagacgagtcggaggagcgagcggaggagaagatcagcttgagagccggcctggaccctcctcaggaggaatgaatctcccgcaggtggttgacctgtttccagaactgagacgggtcctgactatcagggaggatggtcagtttgtgaagaagtttaagagggatcggggtgagggagatgatgaggcggctagcaatttagcttttagtctgatgactcgccaccgaccggaatgtattacctatcagcagattaaggagagttgtgccaacgagctggatcttttgggtcagaagtatagcatagaacagcttaccacttactggcttcagcctggggatgattgggaagaggcgatcagggtgtatgcaaaggtggccctgcggcccgattgcaagtataagattactaagttggttaatattagaaactgctgctatatttctgggaacggggccgaagtggagatagatactcaggacagggtggcttttaggtgttgcatgataaacatgtggcccgggatactggggatggatggggtggtgttcatgaatgtgaggtttacgggccccaactttaatggcacggtgttcatgggcaacaccaacttgctcctgcatggtgcgagtttctatgggtttaataacacctgtatagaggcctggaccgatgtaaaggttcgaggttgttccttttatagctgttggaaggcggtggtgtgtcgccctaaaagcaggggttctgtgaaaaaatgcttgtttgaaaggtgcaccttaggcatcctctctgagggcaactccagggtgcgccataatgtggcttcgaactgcggttgcttcatgcaagtgaagggggtgagcgttatcaagcataactcggtgtgtggaaactgcgaggatcgcgcctcccagatgctgacctgctttgatggtaactgtcacctgttgaagaccattcatataagcagccaccccagaaaggcctggcccgtgtttgagcataacatcctgacccgctgctccttgcatctgggggtcaggaggggtatgttcctgccttaccagtgtaactttagccacactaaaatcctgctggaacccgagtgtatgaccaaggtcagcctaaatggcgtgtttgatgcgactctgagaatctggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgtaccagggccgagtttgggtctagcgatgaggataccgattgaggtgggtaaggtgggcgtggctagcagggtggggcgtgtataaattgggggtctaagggtctctctgttttgtcttgcaacagccgccgccatgagcgacaccggcaacagctttgatggaagcatctttagcccctatttgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcagcgcggcctctcgcgcgtctgctcgggatgagaaactgaccgctctgctgcttaaactggaagacttgacccgggagctgggtcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataagacatctttacaaatcgggggcggagggtcccggactggggtatgatggtaccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagcctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcgccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtcctgaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaaggaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacgggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcctcctggagatctcctcgtccggcgcgctccacggtggccgccaggtcgttggagatgcgacccatgagctgcgagaaggcgttgagcccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacgccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcataaggcggtggtatccgtagatgtacctggacatccaggtgatgccggcggcggtggtggtggcgcgcgcgtagtcgcggacccggttccagatgtttcgcaggggcaagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgagggccgtggcagccccgtcctcaggaccccgccagccgacttctccagttacgggagcgagccccttttgtttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtgaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggacgatgaccaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgagtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggatgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttgaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggaaacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacgcaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcattaaccgcctgatggactacttgcatcgggcggcggccgtgaaccccgagtacttcactaatgccattctgaatccccactggatgccccctccgggtttctacaacggggacttcgaggtgcccgaggttaacgacgggttcctctgggatgacatggatgacagtgtgttctcacccaacccgctgcgcgccgcgtctctgcgattgaaggagggttctgacagggaaggaccgaggagtctggcctcctccctggctctgggagcggtgggcgcggcggcgcggggcagtagccccttccccagcctggcagactctctgaacagcgggcgggtgagcaggccccgcttgctaggcgaggaggagtatctgaacaactccctgctgcagcccgcgagggacaaaaacgctcagcggcagcagtttcccaacaatgggatagagagcctggtggacaagatgtccagatggaagacgtatgcgcaggagtacaaggagtgggaggaccgccagccgcggcccctgccgccccctaggcagcgctggcagcggcgcgcgtccaaccgccgctggaggcaggggcccgaggacgatgatgactctgcagatgacagcagcgtgctggacctgggcgggagcgggaaccccttttcgcacctgcgcccccgcctgggcaagatgttttaaaagagaaaaaataaaaactcaccaaggccatggcgacgagcgttggttttttgttcccttccttagtatgcgacgcgcggcgatgttcgaggaggggcctcccccctcttacgagagcgcgatgggattttctcctgcgacgcccctacagcctccctacgtgcctcctcggtacctgcaacctaccgggggaagaaatagcatctgttactctgagctgcagcccctgtatgacaccaccaaagtgtacctggtggacaacaagtctgcggacgtggcctccctgaactaccagaacgaccacagcgattttttgaccaccgtgatccaaaacaatgacttcaccccaaacgaggccagcacccagaccataaacctggacaacaggtcgcactggggcggtgatctgaagaccatcttgcacaccaacatgcccaacgtgaatgagtttatgtttactaactcttttaaggcgcgggtaatggtggcgcgcgacgataagggagtgcctaaatacgagtgggtggactttacactgcccgagggcaactactccgagatcatgactcttgacctgatgaacaacgcgatcgtggagcactacttgaaagtaggcaggcagaacggggtaaaagaaagcgatattggagttaagtttgacaccaggaactttcgcctgggatgggaccccgagacggggttggttatgcccggggtttacactaatgaagcttttcaccccgatatagtgctcttgcccggatgcggggtggacttcacccaaagccggctgagcaacctgctgggcattcgaaagcgccagccattccaggaggggtttcaaatcacttatgagcatttggaagggggcaacattccggcgcttctggatttggtcgcctacgaggagagtttgaaatccgaggaaagcggggataacactgacaagggcggcgaggagcaagccggcgatggcgacactgcttcggtagaaaacgaaagtgcgtccgtggtggaggcggcggcggtagcgaccgcagagccggagaccgtagaggaggatatgaatgatagcgcaatcagaggagactcgtttattccccggggcgaagaaaagaaggcggaggctgcggcagcagtcgaagcagagcccaaagtcgagtcggagatcatggaggaggatttgaatgataacgcgatcagaggtgatacgtttgtgccgcggggcgaagaaaaaaaagcggaggcggaggccgcggctgaggaggcggccgaggctgtggcagccaccgcggcggtgactgaaacaactgaggagcaggttcaggccgagcaggttcaaaagaagcccgtgattaaagccctaacacaagatagcaaggagcgcagttacaacttgattcccggtagtactgacaccgagtaccgcagctggtacctggcatacaactacggcgacccggtcaaaggggtgcgctcgtggactctgctttgcacgccggacgtcacctgcggctccgagcagatgtactggtcgttgccaaacatgatgcaagacccggtgaccttccgctccacgcggcaggttaacaacttcccggtggtgggcgccgaactgctgcccgtgcactccaagagcttttacaacgagcaggccgtgtactcccagctgatccgccaggccacctctctgacccacgtgttcaatcgctttcccgagaaccagattttggcgcgcccgccggcccccaccatcactaccgtcagtgaaaacgttcctgctctcacagatcacgggacgctaccgctgcgcaacagcatctcaggagtccagcgagtgaccattactgacgccagacgccggacctgcccctacgtttacaaggccttgggcatagtctcgccgcgcgtcctctccagccgcactttttaaaacacatattcacccacgcttcaaagattatgtctatacttatctcacccagcaataacaccggctgggggctgcgcgcgcccagcaagatgtttggaggggcgagaaaacgttccgagcagcacccagtgcgcgtgcgcggccactaccgcgcgccctggggagcgcacaagcgcgggcgcgcagggcgcaccactgtggacgacgccattgactccgtagtggagcaggcgcgccactacacacccggcgcgccgtccgcccccgccgtgtccaccgtggacgaggcgatcgaaagcgtggtacagggcgcgcggcactatgccaaccttaaaaatcgccgccgtcgcgtggcccgccgccatcgccggagaccccgggccaccgccgccgcgcgccttgctaaggctctactcaggcgcgccaggcgaactggccgccgggccgccatgagggccgcacggcgggctgccgccagtgcggccgccgcggccccacgggcacgaaggcgcgcggccgctgccgccgccgccgccatttccagcttggcctcaacgcggcgcggtaacatatactgggtgcgcgactcgataaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgatgacgaggcggtggagtttgtccgccgcatggcacccaggcgccccgtgcagtggaagggtcggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtgaccctgcaacaggtgctgcctttgagcgcgcccagcgagcataagcgagggttgaagcgcgagggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcagcggccagcgccaccaccggcaccgcttcggtagaggtgcagacggacccctggctacccgccgccgctgtcgccgccgccgccgccccccgttctcgcgggcgcaagagaaattatccagtggccagcgcgctcatgccccagtacgcactgcatccatccatcgcgcccacccccggctaccgcgggtattcgtaccgcccgcgcagatcggccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcatttttttggaggaaaaataaaaaagtctagactctcacgctcgcttggtcctgtgactattttgtagaaaaaagatggaagacatcaactttgcgtcgctggccccgcgtcatggctcgcgcccgttcatgggagactggacagatatcggcaccagcagtatgagcggtggcgccttcagctggggcagtctgtggagcggccttaaaaattttggttccaccattaaaaactatggcaacaaagcgtggaacagcagcacgggccagatgctaagagacaagttgaaagagcagaacttccaggagaaggtggcgcagggcctggcctctggcatcagcggggtggtggacatagctaaccaggccgtgcagaaaaagataaacagtcatctggacccccgccctcaggtggaggaaacgcctccagccatggagacggtgtttcccgagggcaaaggcgaaaagcgcccgcggcccgacagggaagagaccctggtgtcacacaccgaggagccgccctcttacgaggaggcactcaaggccggcctgcccaccactcgccccgtagctcccatggccacaggtgtggtgggccataaacaacacacccccgcaacactagatctgcccccgccgtccgagccgccgcgtcagccaaagacggcgacggtgcccgctccctccacttccgccgccaacagagtgtccctgcgccgcactacgggcgcccctcggggaccgcgactgagcggcaactggcagagcacactgaacagcattgtgggcctgggagtgaaaagtgtgaagcgccgccgttgctactgaatgagcaagctagctaacgtgttatatgtgtgtatgcgtcctatgtcgccgccagaggagctgttgagccgcccgcgccgtctgcactccagcgaatttcaagatggcgaccccttcgatgatgccacagtggtcgtacatgcacatctcgggccaggacgcctcggagtacctgagccccgggctggtgcagttcgcccgcgccaccgacagctacttcagcctaagtaacaaatttaggaaccctacggtggcacccacccacgatgtgaccacggaccggtcgcagcgcctgacgctgcggtttatccccgtggatcgggaggacactgcctactcttacaaggcgcgcttcacgctagccgtgggcgacaaccgcgtgctggacatggcctccacctactttgatatccggggtgtgctggacaggggtcccacctttaagccctactcgggcactgcctacaactccctggctcctaaaggcgctcccaattcttgcgagtgggatgaaaaaactaatactgctgaagcagccattgaaaatgaagaagagctggcggatgagccagaagagcaagcagaagaggctataaaaaccaatgtgtttgcccaggcgccatattctggcaatgcaatttccaaagaaggaatacaagtaggcatagaaggcattggagagcaagtaaaagccgtatacgcagacaaaacctaccagccggaacctcaggttggagaaactcaatggaatgagactgaaataaatcatggagcaggaagggtgctgaagaagaccactcccatgaagccttgctatggttcttatgctaaacctactaatgaatatggaggccagggcatccttgtagaaaaaaatggcaaaatggaaagccaggtggaaacacagttttttgctcttgacggtgaaaatgataatagtccaaaagtggtgttgtatagcgaagatgtaaacttggatactcctgacacacacctatcatacaaacctagcgcccaagatgtaaactctaaagaaatgttgggccaacaggccatgcccaacaggccaaatcttattgcttttagggacaactttattggacttatgtactacaacagcactggcaacatgggagtgctggcaggacaggcctcccaactaaatgccgtggtagacttgcaagacagaaacacagagttgtcataccagctgatgcttgattccattggagacagatcaagatattttgccatgtggaaccaggcggttgatagttacgatccagatgttagaattattgaaaaccatggcacagaggatgaacttccaaactactgttttcctttgggaggaatatttaatactcagagttttaaaaaggtaaaacctggaacggataacggatgggaaacagatgatgacttttcagataaaaatgaaataagagttggcaacaactttgccatggagatcaatatccaggcaaacctgtggagaagcttcttgtattccaatgtggctctctacctgccagataagatgaagtactctccaaccaacatagacatttccaccaacactaacacctatgactacatgaacaaaagagtggcgcctccaggcctggtggactgctatgtcaatctgggggccaggtggtcccttgatgtaatggataacatgaacccctttaaccaccaccgcaatgcgggcctgcgataccgttccatgcttctgggtaacggccgctacgtgcccttccacatccaggtgccccaaaagttctttgccatcaaaagccttctactcttgcctggctcgtacacctacgaatggaatttcagaaaggatgtgaacatggtcctacagagctctctgggcaacgaccttagggtggatggggccagcatcaagtttgacagcatcaccctttatgctacctttttccccatggcccacaacaccgcttccacgcttgaggccatgctcagaaacgacaccaacgaccagtccttcaatgactacctctctggggccaacatgctctaccccatccccgccaacgctaccaacgtgcccatctccattccctctcgcaactgggccgccttcagaggctgggcatttacccgccttaagaccaaggagaccccctccctgggctcgggttttgacccctactttgtctactcgggatccatcccctacctggatggcaccttctacctcaaccacacttttaagaagatatccatcatgtatgactcctctgtcagctggccgggcaacgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccgttggcatcactcaccagcacaacaactcgggattcgtgggctacctggcacccaccatgcgcgagggacaggcctaccccgccaacttcccctaccccttgataggcaagaccgcggtcgacagcgtcacccagaaaaagttcctctgcgaccgcaccctctggcgcatccccttttctagcaacttcatgtccatgggcgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacttgctacctctttgacccttttggcttctccgatcagcgcctcaagcagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcgcatccggggggccacctctttctgccacttgcaagaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggttcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattatgcacgctggccagcaggctctcgtcgctgatcatgtcgctgtccagatcctccgcgttgctcagggcgaatggggtcatcttgcagacctgcctgcccaggaaaggcggcagcccgggcttgccgttgcagtcgcagcgcaggggcatcagcaggtgcccgcggcccgactgcgcctgcgggtacagcgcgcgcatgaaggcttcgatctgcctgaaagccacctgcgccttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtcccgtgcagacacttcaggtcgccctccgtctgggtgcagcggtgctcccacagcgcgcaaccggtgggctcccaattcttgtgggtcacccccgcgtaggcctgcaggtaggcctgcaagaagcgccccatcatggccacgaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagcgccgcctgctcttcttcgtcttcgctgtctaccactatctctggggaagggcttctccgctctgcggcggtgcgcttcttttttttcttgggagcagccgtgacggagtccgccacggcgacggaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcctctcgagctggtcttggtctcgactggccattgtatcctcctcctcctaggcagagagacataaggagtctatcatgcaagtcgagaaggaggagagcttaaccaccccctctgacaccgccgatgcgcccgccgtcgccgtcgcccccgctgccgccgacgcgcccgccacaccgagcgacacccccgcggacccccccgccgacgcacccctgttcgaggaagcggccgtggagcaggacccgggctttgtctcggcagaggaggatttgcgagaggaggagaataaggagaagaagccctcagtgccaaaagatgataaagagcaagacgagcacgacgcagatgcacaccagggtgaagtcgggcggggggacggagggcatggcggcgccgactacctagacgaagggaacgacgtgctcttgaagcacctgcatcgtcagtgcgccatcgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgccttcgtggtgcccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtgccaaagatctttgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctaaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgcggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgtctggaggagcgcaacctcaaagagctggagaagctcctgcagcgcgcgctcaaagacctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaggaccaatcccgcccgcccaaggcggagctgaccgcctgcgtcatcacccagggcgagatcctaggccaattgcaagccatccaaaaagcccgccaagattttttgctgaagaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcgattaccaccacgccccgcaataatcccaaccccagggagtggcccgcgtccctggtgtatcaggaaattcccggccccaccaccgtactacttccgcgtgattcccaggccgaagtccaaatgactaactcaggggcgcagctcgcgggcggctgtcgtcacagggtgcggccccctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctccggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgagaaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgattttatagaaccccagtgcaatatcacttataaatctgaatataacctctgcactatcctaattaaatgcgttactcaacacgatgaggtaactgttagatacaaagatcaatcaaaaagagacgcactttacagcagctggcaaccaggagatgaacaaaaatacaatgtgaccgtcttccagggcaaactctccaaaacttacaattacactttcccattcgaggagatgtgtgagtttgtcatgttcatgtcaaagcagtacaagatgtggcctccgactccccagggctgtgtggaaaatccaggctctttctgcatgatctctctctgtgtaactgtgctggcactaatactcacgcttttgtatatcagatttaaatcaaggcaaagcttcatcgatgaaaagaaaatgccttaatcgcttttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatttaaccttgattgatgttcaattgctggatgcgggctactattatgggcagctgggtacaatcgttaattactggagaccccacaaagattacatgcttcacgtagtaaagggtccccttagcagcccgaccactaccaccacctctaccacacccactaccaccactactcccatcaccagcactgccacccagcctcctcatagcagaacaaccacttttatcaattccaagtcccactccccccacattgccggcgggccctccgcctcaaactccgagaccaccgagatctgcttctgcaaatgctctgacgccattgcccaggatttggaagaccacgaggaagatgagcatgacttcgcagatgcatgccaggcatcaggggcagaagcactgccggtggccctcaaacagtatgcagactcccataccacccccgatcttccaccgccttcccagaagccaagtttcctgggggaaaatgaaacactgcctctctccatacttgctttgacatctgttgctattctgactgctctgctggtgctcctatgctctatatgctacctgatctgctgcaggaagaaaaaatctcacggccatgctcaccagccgcttatgcacttcccttaccctccagagttgggcgaccacaaactttaagtctgcagtagctatctgcccatcccttgtcagtcgacagcgatgagccccactaatctaacggcctctggacttacaacattgtctcttaatgagaccaccgctcctcaagacctgtacgatggtgtctccgcgctggttaaccagtgggatcacctgggcatatggtggctcctcataggagcagtgaccctgtgcctaatcctggtctggataatctgctgcatcaaaagcagaagacccaggcggcggcccatctacaggcccttcgtcatcacacctgaagatgatgatggcaccacgtccaggctgcagagcctaaagcagctactcttctcttttacagcatggtaaattgaacatgcctcgcattttcatctacttgtttcttcttccactctttttgggctcttctacattggcagctgtgtcccacatcgaggtagactgcatctcgcccttctcagtctacttactcttcggctttgtcatttgcaactttgtctgcagcgttatcactgtagtgatctgcttcatacagtgcatcgactacgtctgcgtacgggtggcctattttagacaccacccccagtatcgcaacagggacatagcggctctcctaagacttgtttaaatcatgcccaaattaactgtgattgctcttctgattatctgctgcgtcctagccgcgattgggactcagcctactaccaccaccaccagcgctcccagaaagagacatgtttcctgcagcttcaaacgtccctggaatataccccaatgctttactgatgaacctgaaatctctttggcttggtacttcagcgtcaccgcccttctcatcttctgcagtacggttattgcccttgccatttacccttcccttgacctgggctggaatgctgtcaactctatggaatatcccaccttcccagaaccagacctgccagacctggttgttctaaacgcgtttcctcctcctcccgttcaaaatcagtttcgccctccgtccccgacgcccactgaggtcagctactttaatctaacaggcggagatgactgaaaacctagacctagaaatggacggcctctgcagcgaacaacgcatactagagaggcgccggcaaaaagcagagctcgagcgtcttaaacaagagctccaagacgcggtggccatacaccagtgcaaaaaaggtgtcttctgtctagtgaaacaggccacgctcacctatgaaaaaacaggtgacacccaccgcctaggatacaagctgcccacacaacgccagaagttcgcccttatgataggcgaacaacccatcaccgtcacccagcactctgtggagacagaaggctgcatacacgctccctgcaggggcgctgactgtctctacaccttgatcaaaaccctctgcggccttagagacctcatccctttcaattgatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtcccttttcccacccctccctttgtgtcccccgcaggaatgcaagaaaacccccctggagtgctatccctacgccttgcagaacccttgaccacctccaatggagcgctgaccctaaaaatggggggtggtttgaccctggacgaagaaggaaagcttacttcccaaaatattaccagtgttgatcctcctcttaaaaaaacaaaaaacaatatcagtctgcagactgcctccccccttgccgtcagctcgggagccctcacacttttcgctactcctcccctggcagttaatgacaataacctaactgtgcagtctcaggctccccttacactggaaaactcaaaactaagtctggccaccaaaggccccctaaccgtttctgaaggaaaacttgccctagaaacagaggctcccttgcatgcaagcgacagcagtagcctaggccttagtgtaacggccccactgagcattagcagcgacagcctaggactagacttgcaagcgcccattatttctgaaaatggaaaactgggcctaagagtaacaggtcccctaactgtggccagcagtattgatgctttgacagtagccacaggcagcggtattggacttgatagcaacacgcgcctacaggcaaaattggtcgcgcccctaggctttgacaccaatggcaacattaagctcagcacttcgggcggcatgagactgaacaatggcacacttatactagatgtaaactacccatttgaggctcaaggtcaacttagtctaagagtgggttcgggtccactgtatgtagactccaacacacataacctaaccgctagatgccttagagggctatacataacgtcatctaataaccaaaccggcctggaggccaacataaaacttacaaaaggacttgtgtttgatggaaatgccatagcagttaatgttagcaaagggctagaatacagtaccactgaaacagcgcagggtgtaaatcccatacagactaaaataggtttgggcatggaatatgataccaatggagccataaagccaagactaggctctggtttgagctttgataattcaggagctattgtagtgggaaacaaaaatgatgacactcttactctgtggactacaccagacccatctcccaactgtcagattaactcggaaaaagatgctaaactaaccttggtactaaccaagtgcggtagtcaaattgtaggcacagtatctgcctttgctcttaaaggcagccttgccccaattaatggcacagtgagctcagttagtatattcctaagatttaatgaaaatggggtactgatgagcaactcatcgttggaaagccaatactggaattacaggaatggaaattcaactaatgccacaccatatacaaatgcactaggttttatgcctaacctggcagcttatcccaaaggccaggcaacgactgcaaaaagcagcatcattagccaggtttacatgaatggtgacacttccaaacctatgatatttacaataacttttaatgggcttgaaacagaggaaactcaggtcagtacatattccatgacattttcatggaggtggacaaatggagactacgtggggcactattttaaaacaaactcctttactttctcctacattgcccaagaataaagaaagcacagagatgcttgtttttgatttcaaaattgtgtgcttttatttatttcaagcttacagtatttccagtagtcattcgaatagagcttaattaaactgcatgagaacccttccacatagcttaaattagcaccagtgcaaatggagaaaaatcaacatacctttttatccagatatcagagaactctagtggtcagttttcccccaccctcccagctcacagaatacacagtcctttccccccggctggctttaaacaacactatctcattggtaacagacatattcttaggtgtaataatccacacggtctcttggcgggccaaacgctggtcggtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgcagcaacaaggcgcgcagcaactcctgccgccgcctctccgtacggcaggaatgcaacggcgtggtggtctcctccgcgataatccgcaccgctcgcagcatcagcatcctcgtcctccgggcacagcagcgcatcctgatctcactgagatcggcgcagtaagtgcagcacaaaaccaagatgttatttaagatcccacagtgcaaagcgctgtacccaaagctcatggcgggaaggacagcccccacgtgaccatcataccagatcctcaggtaaatcaaatgacgacctctcataaacacgctggacatgtacatcacctccttgggcatgtgctgattcaccacctctcgataccacaagcatcgctgattaattaaagacccctcgagcaccatcctgaaccaggaagccagcacctgaccccccgccaggcactgcagggaccccggtgaatcgcagtggcagtgaagactccagcgctcgtagccgtgaaccatagagctggtcattatatccaaattggcacaacacagacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgttcggtgtagtagttgtaatacagccactccctgagaccgtcaaggcgctccctggcgtccggatctatgacaacaccgtcctgcagcgccgccctgatgacatccaccaccgtagagtatgccaagcccagccaggaaatgcattcactttgacagcgagagataggaggagcggggagagatggaagaaccatgatagtaaagagaacttttattccaatcgatcttctaagatatcaaagtggagatctataagatgacactggtctcctccgctgagtcgatcaaaaataacagctaaaccacaaacaacacgattggtcaaatgctccacaagggcctgcagcataaaattgcctcggaactccaccgcaagcataacatcaaagccaccgcctctatcgtgatcaagaataaaaaccccacagctatccaccagacccatatagttttcatctctccatcgtgaaaaaagatttacaagctcctcctttaaatcacctccaaccaattgaaaaagttgaaccagaccgccctccaccttcattttcagcaagcgtatcatgattgcaaaaattcaggctcctcagacacctgtataagattgagaagcggaacgttaacatcgatgtttcgctcgcgtaaatcacgcctcagtgcaagcataatataatcccacaggtcggagcggatcagcgaggacacctccccgccaggaaccaactcaacggagcctatgctgattataatacgcatattcggagctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacgaccacagaaaaatgcacaatttttctctcaaacatgactgcgagccctgcaaaaaataaaaaagaaacattacacaagagtagcctgtcttacgatgggatagactactctaaccaacataagacgggccacaacatcgcccgcgtggccataaaaaaaattgtccgtgtgattaaaaagaagcacagatagctggccagtcatatccggagtcatcacgtgtgaacccgtgtagacccccgggttggacacatcggccaaagaaagaaagcggccaatgtacccaggaggaattataacactaagacgaagatacaacagaataaccccatgagggggaataacaaagttagtaggtgaataaaaacgataaacacccgaaactccctcctgcgtaggcaaaatagcaccctccccttccaaaacaacatatagcgcttccacagcagccatgacaaaagactcaaaacactcaaaagactcagtcttaccaggaaaataaaagcactctcacagcaccagcactaatcagagtgtgaaaagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccgctttctcacgatacgtcacttccgcaagaaaagcaaaactacatttcccacatgtgtaaaaacgaaaccccgccccttctaaccgcccacaacttacatcatcaaaacgtaaagtcctacgtcacccgccccgcctctccccgcccacctcattatcatattggccacaatccaaaataaggtatattat

SEQ ID NO: 20 - DNA, 37058 bp, Gorilla beringei graueri
ataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcaccgtcatttgacgcggagggtatttaaacccgctgcgctcctcaagaggccactcttgagtgccagcgagaagagttttctcctctgctccgcttcggtgatcgaaaaatgagacacatagcctgcactccgggtcttttgtccggtcgggcggcggccgagcttttggacgctttgatcaatgatgtcctgagcgatgattttccgtctactacccactttagcccacctactcttcacgaactgtacgatctggatgtactggtggatgtgaacgatcccaacgaggaggcggtttctgcgttttttcccgagtctgcgctgttggccgctcaggagggatttgacctacacactccgccgcctattttagagtctccgctgccggagcccagtggtataccttatatgcctgaactgcttcccgaagtggtagacctgacctgccacgagcctggctttccgcccagcgacgatgatggtgagccttttgttttagactttgctgagatacctgggcacggttgcaggtcttgtgcatatcatcagagggttaccggagaccccgaggttaagtgttcgctgtgctatatgaggatgacctcttcctttatctacagtaagtttttgtctaggtgggcttttgggtaggtgggttttgtgtcagaacaggtgtaaacgttgcttgtgttttttgtacctgtaggtccggtgtccgagccagacccggagcccgaccgcgatcccgagccggatcccgagcctcctcgcaggacaaggaaactaccttccattctgtgcaagtctcagacacctgtaaggaccagcgaggcagacagcaccgactctggcacttctacctctccccctgaaattcacccagtggttcctctgggtatacataaacctgttgctgttagagtttgcgggcgacgccctgcagtacagtgcattgaggacttgcttcacgatcccgaggaacctttggacttgagccttaaacgccctaggcaataaaccccacctaagtaataaaccccacctaagtaataaaccctgccgcccttggttattgagatgacgcccaatgtttgcttttgaatgacttcatgtgtgtaataaaagtgagtgtgatcataggtctcttgtttgtctgggcggggcttaagggtatataagtttctcggggctaaacttggttacacttgaccccaatggaggcgtgggggtgcttggaggagtttgcggacgtgcgccgtttgctggacgagagctctaaccatacctatactatttggaggtatctgtggggctctactcaggccaagttggtctccagaattaagcaggattacaagtgcgattttgaagagctttttagttcctgcggtgagcttttgcaatccttgaatctgggccatcaggctattttccaggaaaaggttctctcgactttggatttttccactcccgggcgcaccgccgcttgtgtggcttttgtgtcttttgtgcaagataaatggagcgaggagacccacctgagtcacggctacgtactggatttcatggcgatggctctttggagggctcacaacaaatggaagattcagaaggaactgtacggttccgccctacgtcgtccacttttgtcgcgacaggggctgaggtttcccgaccatcggcagcatcagaatctggaagacgagtcggaggagcgagcggaggagaagatcagcttgagagccggcctggaccctcctcaggaggaatgaatctcccgcaggtggttgacctgtttccagaactgagacgggtcctgactatcagggaggatggtcagtttgtgaagaagtttaagagggatcggggtgagggagatgatgaggcggctagcaatttagcttttagtctgatgactcgccaccgaccggaatgtattacctatcagcagattaaggagagttgtgccaacgagctggatcttttgggtcagaagtatagcatagaacagcttaccacttactggcttcagcctggggatgattgggaagaggcgatcagggtgtatgcaaaggtggccctgcggcccgattgcaagtataagattactaagttggttaatattagaaactgctgctatatttctgggaacggggccgaagtggagatagatactcaggacagggtggcttttaggtgttgcatgataaacatgtggcccgggatactggggatggatggggtggtgttcatgaatgtgaggtttacgggccccaactttaatggcacggtgttcatgggcaacaccaacttgctcctgcatggtgcgagtttctatgggtttaataacacctgtatagaggcctggaccgatgtaaaggttcgaggttgttccttttatagctgttggaaggcggtggtgtgtcgccctaaaagcaggggttctgtgaaaaaatgcttgtttgaaaggtgcaccttaggcatcctctctgagggcaactccagggtgcgccataatgtggcttcgaactgcggttgcttcatgcaagtgaagggggtgagcgttatcaagcataactcggtgtgtggaaactgcgaggatcgcgcctcccagatgctgacctgctttgatggtaactgtcacctgttgaagaccattcatataagcagccaccccagaaaggcctggcccgtgtttgagcataacatcctgacccgctgctccttgcatctgggggtcaggaggggtatgttcctgccttaccagtgtaactttagccacactaaaatcctgctggaacccgagtgtatgaccaaggtcagcctaaatggcgtgtttgatgcgactctgagaatctggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgtaccagggccgagtttgggtctagcgatgaggataccgattgaggtgggtaaggtgggcgtggctagcagggtggggcgtgtataaattgggggtctaagggtctctctgttttgtcttgcaacagccgccgccatgagcgacaccggcaacagctttgatggaagcatctttagcccctatttgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcagcgcggcctctcgcgcgtctgctcgggatgagaaactgaccgctctgctgcttaaactggaagacttgacccgggagctgggtcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataagacatctttacaaatcgggggcggagggtcccggactggggtatgatggtaccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagcctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcgccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtcctgaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaaggaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacgggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcctcctggagatctcctcgtccggcgcgctccacggtggccgccaggtcgttggagatgcgacccatgagctgcgagaaggcgttgagcccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacgccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcataaggcggtggtatccgtagatgtacctggacatccaggtgatgccggcggcggtggtggtggcgcgcgcgtagtcgcggacccggttccagatgtttcgcaggggcaagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgagggccgtggcagccccgtcctcaggaccccgccagccgacttctccagttacgggagcgagccccttttgtttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtgaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggacgatgaccaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgagtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggatgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttgaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggaaacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacgcaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcattaaccgcctgatggactacttgcatcgggcggcggccgtgaaccccgagtacttcactaatgccattctgaatccccactggatgccccctccgggtttctacaacggggacttcgaggtgcccgaggttaacgacgggttcctctgggatgacatggatgacagtgtgttctcacccaacccgctgcgcgccgcgtctctgcgattgaaggagggttctgacagggaaggaccgaggagtctggcctcctccctggctctgggagcggtgggcgcggcggcgcggggcagtagccccttccccagcctggcagactctctgaacagcgggcgggtgagcaggccccgcttgctaggcgaggaggagtatctgaacaactccctgctgcagcccgcgagggacaaaaacgctcagcggcagcagtttcccaacaatgggatagagagcctggtggacaagatgtccagatggaagacgtatgcgcaggagtacaaggagtgggaggaccgccagccgcggcccctgccgccccctaggcagcgctggcagcggcgcgcgtccaaccgccgctggaggcaggggcccgaggacgatgatgactctgcagatgacagcagcgtgctggacctgggcgggagcgggaaccccttttcgcacctgcgcccccgcctgggcaagatgttttaaaagagaaaaaataaaaactcaccaaggccatggcgacgagcgttggttttttgttcccttccttagtatgcgacgcgcggcgatgttcgaggaggggcctcccccctcttacgagagcgcgatgggattttctcctgcgacgcccctacagcctccctacgtgcctcctcggtacctgcaacctaccgggggaagaaatagcatctgttactctgagctgcagcccctgtatgacaccaccaaagtgtacctggtggacaacaagtctgcggacgtggcctccctgaactaccagaacgaccacagcgattttttgaccaccgtgatccaaaacaatgacttcaccccaaacgaggccagcacccagaccataaacctggacaacaggtcgcactggggcggtgatctgaagaccatcttgcacaccaacatgcccaacgtgaatgagtttatgtttactaactcttttaaggcgcgggtaatggtggcgcgcgacgataagggagtgcctaaatacgagtgggtggactttacactgcccgagggcaactactccgagatcatgactcttgacctgatgaacaacgcgatcgtggagcactacttgaaagtaggcaggcagaacggggtaaaagaaagcgatattggagttaagtttgacaccaggaactttcgcctgggatgggaccccgagacggggttggttatgcccggggtttacactaatgaagcttttcaccccgatatagtgctcttgcccggatgcggggtggacttcacccaaagccggctgagcaacctgctgggcattcgaaagcgccagccattccaggaggggtttcaaatcacttatgagcatttggaagggggcaacattccggcgcttctggatttggtcgcctacgaggagagtttgaaatccgaggaaagcggggataacactgacaagggcggcgaggagcaagccggcgatggcgacactgcttcggtagaaaacgaaagtgcgtccgtggtggaggcggcggcggtagcgaccgcagagccggagaccgtagaggaggatatgaatgatagcgcaatcagaggagactcgtttattccccggggcgaagaaaagaaggcggaggctgcggcagcagtcgaagcagagcccaaagtcgagtcggagatcatggaggaggatttgaatgataacgcgatcagaggtgatacgtttgtgccgcggggcgaagaaaaaaaagcggaggcggaggccgcggctgaggaggcggccgaggctgtggcagccaccgcggcggtgactgaaacaactgaggagcaggttcaggccgagcaggttcaaaagaagcccgtgattaaagccctaacacaagatagcaaggagcgcagttacaacttgattcccggtagtactgacaccgagtaccgcagctggtacctggcatacaactacggcgacccggtcaaaggggtgcgctcgtggactctgctttgcacgccggacgtcacctgcggctccgagcagatgtactggtcgttgccaaacatgatgcaagacccggtgaccttccgctccacgcggcaggttaacaacttcccggtggtgggcgccgaactgctgcccgtgcactccaagagcttttacaacgagcaggccgtgtactcccagctgatccgccaggccacctctctgacccacgtgttcaatcgctttcccgagaaccagattttggcgcgcccgccggcccccaccatcactaccgtcagtgaaaacgttcctgctctcacagatcacgggacgctaccgctgcgcaacagcatctcaggagtccagcgagtgaccattactgacgccagacgccggacctgcccctacgtttacaaggccttgggcatagtctcgccgcgcgtcctctccagccgcactttttaaaacacatattcacccacgcttcaaagattatgtctatacttatctcacccagcaataacaccggctgggggctgcgcgcgcccagcaagatgtttggaggggcgagaaaacgttccgagcagcacccagtgcgcgtgcgcggccactaccgcgcgccctggggagcgcacaagcgcgggcgcgcagggcgcaccactgtggacgacgccattgactccgtagtggagcaggcgcgccactacacacccggcgcgccgtccgcccccgccgtgtccaccgtggacgaggcgatcgaaagcgtggtacagggcgcgcggcactatgccaaccttaaaaatcgccgccgtcgcgtggcccgccgccatcgccggagaccccgggccaccgccgccgcgcgccttgctaaggctctactcaggcgcgccaggcgaactggccgccgggccgccatgagggccgcacggcgggctgccgccagtgcggccgccgcggccccacgggcacgaaggcgcgcggccgctgccgccgccgccgccatttccagcttggcctcaacgcggcgcggtaacatatactgggtgcgcgactcgataaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgatgacgaggcggtggagtttgtccgccgcatggcacccaggcgccccgtgcagtggaagggtcggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtgaccctgcaacaggtgctgcctttgagcgcgcccagcgagcataagcgagggttgaagcgcgagggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcagcggccagcgccaccaccggcaccgcttcggtagaggtgcagacggacccctggctacccgccgccgctgtcgccgccgccgccgccccccgttctcgcgggcgcaagagaaattatccagtggccagcgcgctcatgccccagtacgcactgcatccatccatcgcgcccacccccggctaccgcgggtattcgtaccgcccgcgcagatcggccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcatttttttggaggaaaaaataaaaaagtctagactctcacgctcgcttggtcctgtgactattttgtagaaaaaagatggaagacatcaactttgcgtcgctggccccgcgtcatggctcgcgcccgttcatgggagactggacagatatcggcaccagcagtatgagcggtggcgccttcagctggggcagtctgtggagcggccttaaaaattttggttccaccattaaaaactatggcaacaaagcgtggaacagcagcacgggccagatgctaagagacaagttgaaagagcagaacttccaggagaaggtggcgcagggcctggcctctggcatcagcggggtggtggacatagctaaccaggccgtgcagaaaaagataaacagtcatctggacccccgccctcaggtggaggaaacgcctccagccatggagacggtgtttcccgagggcaaaggcgaaaagcgcccgcggcccgacagggaagagaccctggtgtcacacaccgaggagccgccctcttacgaggaggcactcaaggccggcctgcccaccactcgccccgtagctcccatggccacaggtgtggtgggccataaacaacacacccccgcaacactagatctgcccccgccgtccgagccgccgcgtcagccaaagacggcgacggtgcccgctccctccacttccgccgccaacagagtgtccctgcgccgcactacgggcgcccctcggggaccgcgactgagcggcaactggcagagcacactgaacagcattgtgggcctgggagtgaaaagtgtgaagcgccgccgttgctactgaatgagcaagctagctaacgtgttatatgtgtgtatgcgtcctatgtcgccgccagaggagctgttgagccgcccgcgccgtctgcactccagcgaatttcaagatggcgaccccttcgatgatgccacagtggtcgtacatgcacatctcgggccaggacgcctcggagtacctgagccccgggctggtgcagttcgcccgcgccaccgacagctacttcagcctaagtaacaaatttaggaaccctacggtggcacccacccacgatgtgaccacggaccggtcgcagcgcctgacgctgcggtttatccccgtggatcgggaggacactgcctactcttacaaggcgcgcttcacgctagccgtgggcgacaaccgcgtgctggacatggcctccacctactttgatatccggggtgtgctggacaggggtcccacctttaagccctactcgggcactgcctacaactccctggctcctaaaggcgctcccaattcttgcgagtgggatgaaaaaactaatactgctgaagcagccattgaaaatgaagaagagctggcggatgagccagaagagcaagcagaagaggctataaaaaccaatgtgtttgcccaggcgccatattctggcaatgcaatttccaaagaaggaatacaagtaggcatagaaggcattggagagcaagtaaaagccgtatacgcagacaaaacctaccagccggaacctcaggttggagaaactcaatggaatgagactgaaataaatcatggagcaggaagggtgctgaagaagaccactcccatgaagccttgctatggttcttatgctaaacctactaatgaatatggaggccagggcatccttgtagaaaaaaatggcaaaatggaaagccaggtggaaacacagttttttgctcttgacggtgaaaatgataatagtccaaaagtggtgttgtatagcgaagatgtaaacttggatactcctgacacacacctatcatacaaacctagcgcccaagatgtaaactctaaagaaatgttgggccaacaggccatgcccaacaggccaaatcttattgcttttagggacaactttattggacttatgtactacaacagcactggcaacatgggagtgctggcaggacaggcctcccaactaaatgccgtggtagacttgcaagacagaaacacagagttgtcataccagctgatgcttgattccattggagacagatcaagatattttgccatgtggaaccaggcggttgatagttacgatccagatgttagaattattgaaaaccatggcacagaggatgaacttccaaactactgttttcctttgggaggaatatttaatactcagagttttaaaaaggtaaaacctggaacggataacggatgggaaacagatgatgacttttcagataaaaatgaaataagagttggcaacaactttgccatggagatcaatatccaggcaaacctgtggagaagcttcttgtattccaatgtggctctctacctgccagataagatgaagtactctccaaccaacatagacatttccaccaacactaacacctatgactacatgaacaaaagagtggcgcctccaggcctggtggactgctatgtcaatctgggggccaggtggtcccttgatgtaatggataacatgaacccctttaaccaccaccgcaatgcgggcctgcgataccgttccatgcttctgggtaacggccgctacgtgcccttccacatccaggtgccccaaaagttctttgccatcaaaagccttctactcttgcctggctcgtacacctacgaatggaatttcagaaaggatgtgaacatggtcctacagagctctctgggcaacgaccttagggtggatggggccagcatcaagtttgacagcatcaccctttatgctacctttttccccatggcccacaacaccgcttccacgcttgaggccatgctcagaaacgacaccaacgaccagtccttcaatgactacctctctggggccaacatgctctaccccatccccgccaacgctaccaacgtgcccatctccattccctctcgcaactgggccgccttcagaggctgggcatttacccgccttaagaccaaggagaccccctccctgggctcgggttttgacccctactttgtctactcgggatccatcccctacctggatggcaccttctacctcaaccacacttttaagaagatatccatcatgtatgactcctctgtcagctggccgggcaacgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccgttggcatcactcaccagcacaacaactcgggattcgtgggctacctggcacccaccatgcgcgagggacaggcctaccccgccaacttcccctaccccttgataggcaagaccgcggtcgacagcgtcacccagaaaaagttcctctgcgaccgcaccctctggcgcatccccttttctagcaacttcatgtccatgggcgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacttgctacctctttgacccttttggcttctccgatcagcgcctcaagcagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcgcatccggggggccacctctttctgccacttgcaagaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggttcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattatgcacgctggccagcaggctctcgtcgctgatcatgtcgctgtccagatcctccgcgttgctcagggcgaatggggtcatcttgcagacctgcctgcccaggaaaggcggcagcccgggcttgccgttgcagtcgcagcgcaggggcatcagcaggtgcccgcggcccgactgcgcctgcgggtacagcgcgcgcatgaaggcttcgatctgcctgaaagccacctgcgccttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtcccgtgcagacacttcaggtcgccctccgtctgggtgcagcggtgctcccacagcgcgcaaccggtgggctcccaattcttgtgggtcacccccgcgtaggcctgcaggtaggcctgcaagaagcgccccatcatggccacgaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagcgccgcctgctcttcttcgtcttcgctgtctaccactatctctggggaagggcttctccgctctgcggcggtgcgcttcttttttttcttgggagcagccgtgacggagtccgccacggcgacggaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcctctcgagctggtcttggtctcgactggccattgtatcctcctcctcctaggcagagagacataaggagtctatcatgcaagtcgagaaggaggagagcttaaccaccccctctgacaccgccgatgcgcccgccgtcgccgtcgcccccgctgccgccgacgcgcccgccacaccgagcgacacccccgcggacccccccgccgacgcacccctgttcgaggaagcggccgtggagcaggacccgggctttgtctcggcagaggaggatttgcgagaggaggagaataaggagaagaagccctcagtgccaaaagatgataaagagcaagacgagcacgacgcagatgcacaccagggtgaagtcgggcggggggacggagggcatggcggcgccgactacctagacgaagggaacgacgtgctcttgaagcacctgcatcgtcagtgcgccatcgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgccttcgtggtgcccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtgccaaagatctttgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctaaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgcggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgtctggaggagcgcaacctcaaagagctggagaagctcctgcagcgcgcgctcaaagacctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaggaccaatcccgcccgcccaaggcggagctgaccgcctgcgtcatcacccagggcgagatcctaggccaattgcaagccatccaaaaagcccgccaagattttttgctgaagaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcgattaccaccacgccccgcaataatcccaaccccagggagtggcccgcgtccctggtgtatcaggaaattcccggccccaccaccgtactacttccgcgtgattcccaggccgaagtccaaatgactaactcaggggcgcagctcgcgggcggctgtcgtcacagggtgcggccccctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctccggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgagaaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgattttatagaaccccagtgcaatatcacttataaatctgaatataacctctgcactatcctaattaaatgcgttactcaacacgatgaggtaactgttagatacaaagatcaatcaaaaagagacgcactttacagcagctggcaaccaggagatgaacaaaaatacaatgtgaccgtcttccagggcaaactctccaaaacttacaattacactttcccattcgaggagatgtgtgagtttgtcatgttcatgtcaaagcagtacaagatgtggcctccgactccccagggctgtgtggaaaatccaggctctttctgcatgatctctctctgtgtaactgtgctggcactaatactcacgcttttgtatatcagatttaaatcaaggcaaagcttcatcgatgaaaagaaaatgccttaatcgcttttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatttaaccttgattgatgttcaattgctggatgcgggctactattatgggcagctgggtacaatcgttaattactggagaccccacaaagattacatgcttcacgtagtaaagggtccccttagcagcccgaccactaccaccacctctaccacacccactaccaccactactcccatcaccagcactgccacccagcctcctcatagcagaacaaccacttttatcaattccaagtcccactccccccacattgccggcgggccctccgcctcaaactccgagaccaccgagatctgcttctgcaaatgctctgacgccattgcccaggatttggaagaccacgaggaagatgagcatgacttcgcagatgcatgccaggcatcaggggcagaagcactgccggtggccctcaaacagtatgcagactcccataccacccccgatcttccaccgccttcccagaagccaagtttcctgggggaaaatgaaacactgcctctctccatacttgctttgacatctgttgctattctgactgctctgctggtgctcctatgctctatatgctacctgatctgctgcaggaagaaaaaatctcacggccatgctcaccagccgcttatgcacttcccttaccctccagagttgggcgaccacaaactttaagtctgcagtagctatctgcccatcccttgtcagtcgacagcgatgagccccactaatctaacggcctctggacttacaacattgtctcttaatgagaccaccgctcctcaagacctgtacgatggtgtctccgcgctggttaaccagtgggatcacctgggcatatggtggctcctcataggagcagtgaccctgtgcctaatcctggtctggataatctgctgcatcaaaagcagaagacccaggcggcggcccatctacaggcccttcgtcatcacacctgaagatgatgatggcaccacgtccaggctgcagagcctaaagcagctactcttctcttttacagcatggtaaattgaacatgcctcgcattttcatctacttgtttcttcttccactctttttgggctcttctacattggcagctgtgtcccacatcgaggtagactgcatctcgcccttctcagtctacttactcttcggctttgtcatttgcaactttgtctgcagcgttatcactgtagtgatctgcttcatacagtgcatcgactacgtctgcgtacgggtggcctattttagacaccacccccagtatcgcaacagggacatagcggctctcctaagacttgtttaaatcatgcccaaattaactgtgattgctcttctgattatctgctgcgtcctagccgcgattgggactcagcctactaccaccaccaccagcgctcccagaaagagacatgtttcctgcagcttcaaacgtccctggaatataccccaatgctttactgatgaacctgaaatctctttggcttggtacttcagcgtcaccgcccttctcatcttctgcagtacggttattgcccttgccatttacccttcccttgacctgggctggaatgctgtcaactctatggaatatcccaccttcccagaaccagacctgccagacctggttgttctaaacgcgtttcctcctcctcccgttcaaaatcagtttcgccctccgtccccgacgcccactgaggtcagctactttaatctaacaggcggagatgactgaaaacctagacctagaaatggacggcctctgcagcgaacaacgcatactagagaggcgccggcaaaaagcagagctcgagcgtcttaaacaagagctccaagacgcggtggccatacaccagtgcaaaaaaggtgtcttctgtctagtgaaacaggccacgctcacctatgaaaaaacaggtgacacccaccgcctaggatacaagctgcccacacaacgccagaagttcgcccttatgataggcgaacaacccatcaccgtcacccagcactctgtggagacagaaggctgcatacacgctccctgcaggggcgctgactgtctctacaccttgatcaaaaccctctgcggccttagagacctcatccctttcaattgatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtcccttttcccacccctccctttgtgtcccccgcaggaatgcaagaaaacccccctggagtgctatccctacgccttgcagaacccttgaccacctccaatggagcgctgaccctaaaaatggggggtggtttgaccctggacgaagaaggaaagcttacttcccaaaatattaccagtgttgatcctcctcttaaaaaaacaaaaaacaatatcagtctgcagactgcctccccccttgccgtcagctcgggagccctcacacttttcgctactcctcccctggcagttaatgacaataacctaactgtgcagtctcaggctccccttacactggaaaactcaaaactaagtctggccaccaaaggccccctaaccgtttctgaaggaaaacttgccctagaaacagaggctcccttgcatgcaagcgacagcagtagcctaggccttagtgtaacggccccactgagcattagcagcgacagcctaggactagacttgcaagcgcccattatttctgaaaatggaaaactgggcctaagagtaacaggtcccctaactgtggccagcagtattgatgctttgacagtagccacaggcagcggtattggacttgatagcaacacgcgcctacaggcaaaattggtcgcgcccctaggctttgacaccaatggcaacattaagctcagcacttcgggcggcatgagactgaacaatggcacacttatactagatgtaaactacccatttgaggctcaaggtcaacttagtctaagagtgggttcgggtccactgtatgtagactccaacacacataacctaaccgctagatgccttagagggctatacataacgtcatctaataaccaaaccggcctggaggccaacataaaacttacaaaaggacttgtgtttgatggaaatgccatagcagttaatgttagcaaagggctagaatacagtaccactgaaacagcgcagggtgtaaatcccatacagactaaaataggtttgggcatggaatatgataccaatggagccataaagccaagactaggctctggtttgagctttgataattcaggagctattgtagtgggaaacaaaaatgatgacactcttactctgtggactacaccagacccatctcccaactgtcagattaactcggaaaaagatgctaaactaaccttggtactaaccaagtgcggtagtcaaattgtaggcacagtatctgcctttgctcttaaaggcagccttgccccaattaatggcacagtgagctcagttagtatattcctaagatttaatgaaaatggggtactgatgagcaactcatcgttggaaagccaatactggaattacaggaatggaaattcaactaatgccacaccatatacaaatgcactaggttttatgcctaacctggcagcttatcccaaaggccaggcaacgactgcaaaaagcagcatcattagccaggtttacatgaatggtgacacttccaaacctatgatatttacaataacttttaatgggcttgaaacagaggaaactcaggtcagtacatattccatgacattttcatggaggtggacaaatggagactacgtggggcactattttaaaacaaactcctttactttctcctacattgcccaagaataaagaaagcacagagatgcttgtttttgatttcaaaattgtgtgcttttatttatttcaagcttacagtatttccagtagtcattcgaatagagcttaattaaactgcatgagaacccttccacatagcttaaattagcaccagtgcaaatggagaaaaatcaacatacctttttatccagatatcagagaactctagtggtcagttttcccccaccctcccagctcacagaatacacagtcctttccccccggctggctttaaacaacactatctcattggtaacagacatattcttaggtgtaataatccacacggtctcttggcgggccaaacgctggtcggtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgcagcaacaaggcgcgcagcaactcctgccgccgcctctccgtacggcaggaatgcaacggcgtggtggtctcctccgcgataatccgcaccgctcgcagcatcagcatcctcgtcctccgggcacagcagcgcatcctgatctcactgagatcggcgcagtaagtgcagcacaaaaccaagatgttatttaagatcccacagtgcaaagcgctgtacccaaagctcatggcgggaaggacagcccccacgtgaccatcataccagatcctcaggtaaatcaaatgacgacctctcataaacacgctggacatgtacatcacctccttgggcatgtgctgattcaccacctctcgataccacaagcatcgctgattaattaaagacccctcgagcaccatcctgaaccaggaagccagcacctgaccccccgccaggcactgcagggaccccggtgaatcgcagtggcagtgaagactccagcgctcgtagccgtgaaccatagagctggtcattatatccaaattggcacaacacagacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgttcggtgtagtagttgtaatacagccactccctgagaccgtcaaggcgctccctggcgtccggatctatgacaacaccgtcctgcagcgccgccctgatgacatccaccaccgtagagtatgccaagcccagccaggaaatgcattcactttgacagcgagagataggaggagcggggagagatggaagaaccatgatagtaaagagaacttttattccaatcgatcttctaagatatcaaagtggagatctataagatgacactggtctcctccgctgagtcgatcaaaaataacagctaaaccacaaacaacacgattggtcaaatgctccacaagggcctgcagcataaaattgcctcggaactccaccgcaagcataacatcaaagccaccgcctctatcgtgatcaagaataaaaaccccacagctatccaccagacccatatagttttcatctctccatcgtgaaaaaagatttacaagctcctcctttaaatcacctccaaccaattgaaaaagttgaaccagaccgccctccaccttcattttcagcaagcgtatcatgattgcaaaaattcaggctcctcagacacctgtataagattgagaagcggaacgttaacatcgatgtttcgctcgcgtaaatcacgcctcagtgcaagcataatataatcccacaggtcggagcggatcagcgaggacacctccccgccaggaaccaactcaacggagcctatgctgattataatacgcatattcggagctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacgaccacagaaaaatgcacaatttttctctcaaacatgactgcgagccctgcaaaaaataaaaaagaaacattacacaagagtagcctgtcttacgatgggatagactactctaaccaacataagacgggccacaacatcgcccgcgtggccataaaaaaaattgtccgtgtgattaaaaagaagcacagatagctggccagtcatatccggagtcatcacgtgtgaacccgtgtagacccccgggttggacacatcggccaaagaaagaaagcggccaatgtacccaggaggaattataacactaagacgaagatacaacagaataaccccatgagggggaataacaaagttagtaggtgaataaaaacgataaacacccgaaactccctcctgcgtaggcaaaatagcaccctccccttccaaaacaacatatagcgcttccacagcagccatgacaaaagactcaaaacactcaaaagactcagtcttaccaggaaaataaaagcactctcacagcaccagcactaatcagagtgtgaaaagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccgctttctcacgatacgtcacttccgcaagaaaagcaaaactacatttcccacatgtgtaaaaacgaaaccccgccccttctaaccgcccacaacttacatcatcaaaacgtaaagtcctacgtcacccgccccgcctctccccgcccacctcattatcatattggccacaatccaaaataaggtatattat

SEQ ID NO: 21 - DNA, 37057 bp, Gorilla beringei graueri
ataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcaccgtcatttgacgcggagggtatttaaacccgctgcgctcctcaagaggccactcttgagtgccagcgagaagagttttctcctctgctccgcttcggtgatcgaaaaatgagacacatagcctgcactccgggtcttttgtccggtcgggcggcggccgagcttttggacgctttgatcaatgatgtcctgagcgatgattttccgtctactacccactttagcccacctactcttcacgaactgtacgatctggatgtactggtggatgtgaacgatcccaacgaggaggcggtttctgcgttttttcccgagtctgcgctgttggccgctcaggagggatttgacctacacactccgccgcctattttagagtctccgctgccggagcccagtggtataccttatatgcctgaactgcttcccgaagtggtagacctgacctgccacgagcctggctttccgcccagcgacgatgatggtgagccttttgttttagactttgctgagatacctgggcacggttgcaggtcttgtgcatatcatcagagggttaccggagaccccgaggttaagtgttcgctgtgctatatgaggatgacctcttcctttatctacagtaagtttttgtctaggtgggcttttgggtaggtgggttttgtgtcagaacaggtgtaaacgttgcttgtgttttttgtacctgtaggtccggtgtccgagccagacccggagcccgaccgcgatcccgagccggatcccgagcctcctcgcaggacaaggaaactaccttccattctgtgcaagtctcagacacctgtaaggaccagcgaggcagacagcaccgactctggcacttctacctctccccctgaaattcacccagtggttcctctgggtatacataaacctgttgctgttagagtttgcgggcgacgccctgcagtacagtgcattgaggacttgcttcacgatcccgaggaacctttggacttgagccttaaacgccctaggcaataaaccccacctaagtaataaaccccacctaagtaataaaccctgccgcccttggttattgagatgacgcccaatgtttgcttttgaatgacttcatgtgtgtaataaaagtgagtgtgatcataggtctcttgtttgtctgggcggggcttaagggtatataagtttctcggggctaaacttggttacacttgaccccaatggaggcgtgggggtgcttggaggagtttgcggacgtgcgccgtttgctggacgagagctctaaccatacctatactatttggaggtatctgtggggctctactcaggccaagttggtctccagaattaagcaggattacaagtgcgattttgaagagctttttagttcctgcggtgagcttttgcaatccttgaatctgggccatcaggctattttccaggaaaaggttctctcgactttggatttttccactcccgggcgcaccgccgcttgtgtggcttttgtgtcttttgtgcaagataaatggagcgaggagacccacctgagtcacggctacgtactggatttcatggcgatggctctttggagggctcacaacaaatggaagattcagaaggaactgtacggttccgccctacgtcgtccacttttgtcgcgacaggggctgaggtttcccgaccatcggcagcatcagaatctggaagacgagtcggaggagcgagcggaggagaagatcagcttgagagccggcctggaccctcctcaggaggaatgaatctcccgcaggtggttgacctgtttccagaactgagacgggtcctgactatcagggaggatggtcagtttgtgaagaagtttaagagggatcggggtgagggagatgatgaggcggctagcaatttagcttttagtctgatgactcgccaccgaccggaatgtattacctatcagcagattaaggagagttgtgccaacgagctggatcttttgggtcagaagtatagcatagaacagcttaccacttactggcttcagcctggggatgattgggaagaggcgatcagggtgtatgcaaaggtggccctgcggcccgattgcaagtataagattactaagttggttaatattagaaactgctgctatatttctgggaacggggccgaagtggagatagatactcaggacagggtggcttttaggtgttgcatgataaacatgtggcccgggatactggggatggatggggtggtgttcatgaatgtgaggtttacgggccccaactttaatggcacggtgttcatgggcaacaccaacttgctcctgcatggtgcgagtttctatgggtttaataacacctgtatagaggcctggaccgatgtaaaggttcgaggttgttccttttatagctgttggaaggcggtggtgtgtcgccctaaaagcaggggttctgtgaaaaaatgcttgtttgaaaggtgcaccttaggcatcctctctgagggcaactccagggtgcgccataatgtggcttcgaactgcggttgcttcatgcaagtgaagggggtgagcgttatcaagcataactcggtgtgtggaaactgcgaggatcgcgcctcccagatgctgacctgctttgatggtaactgtcacctgttgaagaccattcatataagcagccaccccagaaaggcctggcccgtgtttgagcataacatcctgacccgctgctccttgcatctgggggtcaggaggggtatgttcctgccttaccagtgtaactttagccacactaaaatcctgctggaacccgagtgtatgaccaaggtcagcctaaatggcgtgtttgatgcgactctgagaatctggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgcaccagggccgagtttgggtctagcgatgaggataccgattgaggtgggtaaggtgggcgtggctagaagggtggggcgtgtataaattgggggtctaagggtctctctgttttgtcttgcaacagccgccgccatgagcgacaccggcaacagctttgatggaagcatctttagcccctatctgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcagcgcggcctctcgcgcgtctgctcgggatgagaaactgaccgctctgctgcttaaactggaagacttgacccgggagctgggtcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataagacatctttacaaatcgggggcggagggtcccggactggggtatgatggtaccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagcctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcgccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtcctgaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaaggaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacgggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcctcctggagatctcctcgtccggcgcgctccacggtggccgccaggtcgttggagatgcgacccatgagctgcgagaaggcgttgagcccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacgccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcataaggcggtggtatccgtagatgtacctggacatccaggtgatgccggcggcggtggtggtggcgcgcgcgtagtcgcggacccggttccagatgtttcgcaggggcaagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgagggccgtggcagccccgtcctcaggaccccgccagccgacttctccagttacgggagcgagccccttttgtttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtgaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggacgatgaccaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgagtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggatgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttgaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggaaacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacgcaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcattaaccgcctgatggactacttgcatcgggcggcggccgtgaaccccgagtacttcactaatgccattctgaatccccactggatgccccctccgggtttctacaacggggacttcgaggtgcccgaggttaacgacgggttcctctgggatgacatggatgacagtgtgttctcacccaacccgctgcgcgccgcgtctctgcgattgaaggagggttctgacagggaaggaccgaggagtctggcctcctccctggctctgggagcggtgggcgcggcggcgcggggcagtagccccttccccagcctggcagactctctgaacagcgggcgggtgagcaggccccgcttgctaggcgaggaggagtatctgaacaactccctgctgcagcccgcgagggacaaaaacgctcagcggcagcagtttcccaacaatgggatagagagcctggtggacaagatgtccagatggaagacgtatgcgcaggagtacaaggagtgggaggaccgccagccgcggcccctgccgccccctaggcagcgctggcagcggcgcgcgtccaaccgccgctggaggcaggggcccgaggacgatgatgactctgcagatgacagcagcgtgctggacctgggcgggagcgggaaccccttttcgcacctgcgcccccgcctgggcaagatgttttaaaagagaaaaaataaaaactcaccaaggccatggcgacgagcgttggttttttgttcccttccttagtatgcgacgcgcggcgatgttcgaggaggggcctcccccctcttacgagagcgcgatgggattttctcctgcgacgcccctacagcctccctacgtgcctcctcggtacctgcaacctaccgggggaagaaatagcatctgttactctgagctgcagcccctgtatgacaccaccaaagtgtacctggtggacaacaagtctgcggacgtggcctccctgaactaccagaacgaccacagcgattttttgaccaccgtgatccaaaacaatgacttcaccccaaacgaggccagcacccagaccataaacctggacaacaggtcgcactggggcggtgatctgaagaccatcttgcacaccaacatgcccaacgtgaatgagtttatgtttactaactcttttaaggcgcgggtaatggtggcgcgcgacgataagggagtgcctaaatacgagtgggtggactttacactgcccgagggcaactactccgagatcatgactcttgacctgatgaacaacgcgatcgtggagcactacttgaaagtaggcaggcagaacggggtaaaagaaagcgatattggagttaagtttgacaccaggaactttcgcctgggatgggaccccgagacggggttggttatgcccggggtttacactaatgaagcttttcaccccgatatagtgctcttgcccggatgcggggtggacttcacccaaagccggctgagcaacctgctgggcattcgaaagcgccagccattccaggaggggtttcaaatcacttatgagcatttggaagggggcaacattccggcgcttctggatttggtcgcctacgaggagagtttgaaatccgaggaaagcggggataacactgacaagggcggcgaggagcaagccggcgatggcgacactgcttcggtagaaaacgaaagtgcgtccgtggtggaggcggcggcggtagcgaccgcagagccggagaccgtagaggaggatatgaatgatagcgcaatcagaggagactcgtttattccccggggcgaagaaaagaaggcggaggctgcggcagcagtcgaagcagagcccaaagtcgagtcggagatcatggaggaggatttgaatgataacgcgatcagaggtgatacgtttgtgccgcggggcgaagaaaaaaaagcggaggcggaggccgcggctgaggaggcggccgaggctgtggcagccaccgcggcggtgactgaaacaactgaggagcaggttcaggccgagcaggttcaaaagaagcccgtgattaaagccctaacacaagatagcaaggagcgcagttacaacttgattcccggtagtactgacaccgagtaccgcagctggtacctggcatacaactacggcgacccggtcaaaggggtgcgctcgtggactctgctttgcacgccggacgtcacctgcggctccgagcagatgtactggtcgttgccaaacatgatgcaagacccggtgaccttccgctccacgcggcaggttaacaacttcccggtggtgggcgccgaactgctgcccgtgcactccaagagcttttacaacgagcaggccgtgtactcccagctgatccgccaggccacctctctgacccacgtgttcaatcgctttcccgagaaccagattttggcgcgcccgccggcccccaccatcactaccgtcagtgaaaacgttcctgctctcacagatcacgggacgctaccgctgcgcaacagcatctcaggagtccagcgagtgaccattactgacgccagacgccggacctgcccctacgtttacaaggccttgggcatagtctcgccgcgcgtcctctccagccgcactttttaaaacacatattcacccacgcttcaaagattatgtctatacttatctcacccagcaataacaccggctgggggctgcgcgcgcccagcaagatgtttggaggggcgagaaaacgttccgagcagcacccagtgcgcgtgcgcggccactaccgcgcgccctggggagcgcacaagcgcgggcgcgcagggcgcaccactgtggacgacgccattgactccgtagtggagcaggcgcgccactacacacccggcgcgccgtccgcccccgccgtgtccaccgtggacgaggcgatcgaaagcgtggtacagggcgcgcggcactatgccaaccttaaaaatcgccgccgtcgcgtggcccgccgccatcgccggagaccccgggccaccgccgccgcgcgccttgctaaggctctactcaggcgcgccaggcgaactggccgccgggccgccatgagggccgcacggcgggctgccgccagtgcggccgccgcggccccacgggcacgaaggcgcgcggccgctgccgccgccgccgccatttccagcttggcctcaacgcggcgcggtaacatatactgggtgcgcgactcgataaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgatgacgaggcggtggagtttgtccgccgcatggcacccaggcgccccgtgcagtggaagggtcggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtgaccctgcaacaggtgctgcctttgagcgcgcccagcgagcataagcgagggttgaagcgcgagggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcagcggccagcgccaccaccggcaccgcttcggtagaggtgcagacggacccctggctacccgccgccgctgtcgccgccgccgccgccccccgttctcgcgggcgcaagagaaattatccagtggccagcgcgctcatgccccagtacgcactgcatccatccatcgcgcccacccccggctaccgcgggtattcgtaccgcccgcgcagatcggccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcatttttttggaggaaaaataaaaaagtctagactctcacgctcgcttggtcctgtgactattttgtagaaaaaagatggaagacatcaactttgcgtcgctggccccgcgtcatggctcgcgcccgttcatgggagactggacagatatcggcaccagcagtatgagcggtggcgccttcagctggggcagtctgtggagcggccttaaaaattttggttccaccattaaaaactatggcaacaaagcgtggaacagcagcacgggccagatgctaagagacaagttgaaagagcagaacttccaggagaaggtggcgcagggcctggcctctggcatcagcggggtggtggacatagctaaccaggccgtgcagaaaaagataaacagtcatctggacccccgccctcaggtggaggaaacgcctccagccatggagacggtgtttcccgagggcaaaggcgaaaagcgcccgcggcccgacagggaagagaccctggtgtcacacaccgaggagccgccctcttacgaggaggcactcaaggccggcctgcccaccactcgccccgtagctcccatggccacaggtgtggtgggccataaacaacacacccccgcaacactagatctgcccccgccgtccgagccgccgcgtcagccaaagacggcgacggtgcccgctccctccacttccgccgccaacagagtgtccctgcgccgcactacgggcgcccctcggggaccgcgactgagcggcaactggcagagcacactgaacagcattgtgggcctgggagtgaaaagtgtgaagcgccgccgttgctactgaatgagcaagctagctaacgtgttatatgtgtgtatgcgtcctatgtcgccgccagaggagctgttgagccgcccgcgccgtctgcactccagcgaatttcaagatggcgaccccttcgatgatgccacagtggtcgtacatgcacatctcgggccaggacgcctcggagtacctgagccccgggctggtgcagttcgcccgcgccaccgacagctacttcagcctaagtaacaaatttaggaaccctacggtggcacccacccacgatgtgaccacggaccggtcgcagcgcctgacgctgcggtttatccccgtggatcgggaggacactgcctactcttacaaggcgcgcttcacgctagccgtgggcgacaaccgcgtgctggacatggcctccacctactttgatatccggggtgtgctggacaggggtcccacctttaagccctactcgggcactgcctacaactccctggctcctaaaggcgctcccaattcttgcgagtgggatgaaaaaactaatactgctgaagcagccattgaaaatgaagaagagctggcggatgagccagaagagcaagcagaagaggctataaaaaccaatgtgtttgcccaggcgccatattctggcaatgcaatttccaaagaaggaatacaagtaggcatagaaggcattggagagcaagtaaaagccgtatacgcagacaaaacctaccagccggaacctcaggttggagaaactcaatggaatgagactgaaataaatcatggagcaggaagggtgctgaagaagaccactcccatgaagccttgctatggttcttatgctaaacctactaatgaatatggaggccagggcatccttgtagaaaaaaatggcaaaatggaaagccaggtggaaacacagttttttgctcttgacggtgaaaatgataatagtccaaaagtggtgttgtatagcgaagatgtaaacttggatactcctgacacacacctatcatacaaacctagcgcccaagatgtaaactctaaagaaatgttgggccaacaggccatgcccaacaggccaaatcttattgcttttagggacaactttattggacttatgtactacaacagcactggcaacatgggagtgctggcaggacaggcctcccaactaaatgccgtggtagacttgcaagacagaaacacagagttgtcataccagctgatgcttgattccattggagacagatcaagatattttgccatgtggaaccaggcggttgatagttacgatccagatgttagaattattgaaaaccatggcacagaggatgaacttccaaactactgttttcctttgggaggaatatttaatactcagagttttaaaaaggtaaaacctggaacggataacggatgggaaacagatgatgacttttcagataaaaatgaaataagagttggcaacaactttgccatggagatcaatatccaggcaaacctgtggagaagcttcttgtattccaatgtggctctctacctgccagataagatgaagtactctccaaccaacatagacatttccaccaacactaacacctatgactacatgaacaaaagagtggcgcctccaggcctggtggactgctatgtcaatctgggggccaggtggtcccttgatgtaatggataacatgaacccctttaaccaccaccgcaatgcgggcctgcgataccgttccatgcttctgggtaacggccgctacgtgcccttccacatccaggtgccccaaaagttctttgccatcaaaagccttctactcttgcctggctcgtacacctacgaatggaatttcagaaaggatgtgaacatggtcctacagagctctctgggcaacgaccttagggtggatggggccagcatcaagtttgacagcatcaccctttatgctacctttttccccatggcccacaacaccgcttccacgcttgaggccatgctcagaaacgacaccaacgaccagtccttcaatgactacctctctggggccaacatgctctaccccatccccgccaacgctaccaacgtgcccatctccattccctctcgcaactgggccgccttcagaggctgggcatttacccgccttaagaccaaggagaccccctccctgggctcgggttttgacccctactttgtctactcgggatccatcccctacctggatggcaccttctacctcaaccacacttttaagaagatatccatcatgtatgactcctctgtcagctggccgggcaacgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccgttggcatcactcaccagcacaacaactcgggattcgtgggctacctggcacccaccatgcgcgagggacaggcctaccccgccaacttcccctaccccttgataggcaagaccgcggtcgacagcgtcacccagaaaaagttcctctgcgaccgcaccctctggcgcatccccttttctagcaacttcatgtccatgggcgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacttgctacctctttgacccttttggcttctccgatcagcgcctcaagcagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcgcatccggggggccacctctttctgccacttgcaagaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggttcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattatgcacgctggccagcaggctctcgtcgctgatcatgtcgctgtccagatcctccgcgttgctcagggcgaatggggtcatcttgcagacctgcctgcccaggaaaggcggcagcccgggcttgccgttgcagtcgcagcgcaggggcatcagcaggtgcccgcggcccgactgcgcctgcgggtacagcgcgcgcatgaaggcttcgatctgcctgaaagccacctgcgccttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtcccgtgcagacacttcaggtcgccctccgtctgggtgcagcggtgctcccacagcgcgcaaccggtgggctcccaattcttgtgggtcacccccgcgtaggcctgcaggtaggcctgcaagaagcgccccatcatggccacgaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagcgccgcctgctcttcttcgtcttcgctgtctaccactatctctggggaagggcttctccgctctgcggcggtgcgcttcttttttttcttgggagcagccgtgacggagtccgccacggcgacggaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcctctcgagctggtcttggtctcgactggccattgtatcctcctcctcctaggcagagagacataaggagtctatcatgcaagtcgagaaggaggagagcttaaccaccccctctgacaccgccgatgcgcccgccgtcgccgtcgcccccgctgccgccgacgcgcccgccacaccgagcgacacccccgcggacccccccgccgacgcacccctgttcgaggaagcggccgtggagcaggacccgggctttgtctcggcagaggaggatttgcgagaggaggagaataaggagaagaagccctcagtgccaaaagatgataaagagcaagacgagcacgacgcagatgcacaccagggtgaagtcgggcggggggacggagggcatggcggcgccgactacctagacgaagggaacgacgtgctcttgaagcacctgcatcgtcagtgcgccatcgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgccttcgtggtgcccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtgccaaagatctttgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctaaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgcggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgtctggaggagcgcaacctcaaagagctggagaagctcctgcagcgcgcgctcaaagacctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaggaccaatcccgcccgcccaaggcggagctgaccgcctgcgtcatcacccagggcgagatcctaggccaattgcaagccatccaaaaagcccgccaagattttttgctgaagaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcgattaccaccacgccccgcaataatcccaaccccagggagtggcccgcgtccctggtgtatcaggaaattcccggccccaccaccgtactacttccgcgtgattcccaggccgaagtccaaatgactaactcaggggcgcagctcgcgggcggctgtcgtcacagggtgcggccccctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctccggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgagaaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgattttatagaaccccagtgcaatatcacttataaatctgaatataacctctgcactatcctaattaaatgcgttactcaacacgatgaggtaactgttagatacaaagatcaatcaaaaagagacgcactttacagcagctggcaaccaggagatgaacaaaaatacaatgtgaccgtcttccagggcaaactctccaaaacttacaattacactttcccattcgaggagatgtgtgagtttgtcatgttcatgtcaaagcagtacaagatgtggcctccgactccccagggctgtgtggaaaatccaggctctttctgcatgatctctctctgtgtaactgtgctggcactaatactcacgcttttgtatatcagatttaaatcaaggcaaagcttcatcgatgaaaagaaaatgccttaatcgcttttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatttaaccttgattgatgttcaattgctggatgcgggctactattatgggcagctgggtacaatcgttaattactggagaccccacaaagattacatgcttcacgtagtaaagggtccccttagcagcccgaccactaccaccacctctaccacacccactaccaccactactcccatcaccagcactgccacccagcctcctcatagcagaacaaccacttttatcaattccaagtcccactccccccacattgccggcgggccctccgcctcaaactccgagaccaccgagatctgcttctgcaaatgctctgacgccattgcccaggatttggaagaccacgaggaagatgagcatgacttcgcagatgcatgccaggcatcaggggcagaagcactgccggtggccctcaaacagtatgcagactcccataccacccccgatcttccaccgccttcccagaagccaagtttcctgggggaaaatgaaacactgcctctctccatacttgctttgacatctgttgctattctgactgctctgctggtgctcctatgctctatatgctacctgatctgctgcaggaagaaaaaatctcacggccatgctcaccagccgcttatgcacttcccttaccctccagagttgggcgaccacaaactttaagtctgcagtagctatctgcccatcccttgtcagtcgacagcgatgagccccactaatctaacggcctctggacttacaacattgtctcttaatgagaccaccgctcctcaagacctgtacgatggtgtctccgcgctggttaaccagtgggatcacctgggcatatggtggctcctcataggagcagtgaccctgtgcctaatcctggtctggataatctgctgcatcaaaagcagaagacccaggcggcggcccatctacaggcccttcgtcatcacacctgaagatgatgatggcaccacgtccaggctgcagagcctaaagcagctactcttctcttttacagcatggtaaattgaacatgcctcgcattttcatctacttgtttcttcttccactctttttgggctcttctacattggcagctgtgtcccacatcgaggtagactgcatctcgcccttctcagtctacttactcttcggctttgtcatttgcaactttgtctgcagcgttatcactgtagtgatctgcttcatacagtgcatcgactacgtctgcgtacgggtggcctattttagacaccacccccagtatcgcaacagggacatagcggctctcctaagacttgtttaaatcatgcccaaattaactgtgattgctcttctgattatctgctgcgtcctagccgcgattgggactcagcctactaccaccaccaccagcgctcccagaaagagacatgtttcctgcagcttcaaacgtccctggaatataccccaatgctttactgatgaacctgaaatctctttggcttggtacttcagcgtcaccgcccttctcatcttctgcagtacggttattgcccttgccatttacccttcccttgacctgggctggaatgctgtcaactctatggaatatcccaccttcccagaaccagacctgccagacctggttgttctaaacgcgtttcctcctcctcccgttcaaaatcagtttcgccctccgtccccgacgcccactgaggtcagctactttaatctaacaggcggagatgactgaaaacctagacctagaaatggacggcctctgcagcgaacaacgcatactagagaggcgccggcaaaaagcagagctcgagcgtcttaaacaagagctccaagacgcggtggccatacaccagtgcaaaaaaggtgtcttctgtctagtgaaacaggccacgctcacctatgaaaaaacaggtgacacccaccgcctaggatacaagctgcccacacaacgccagaagttcgcccttatgataggcgaacaacccatcaccgtcacccagcactctgtggagacagaaggctgcatacacgctccctgcaggggcgctgactgtctctacaccttgatcaaaaccctctgcggccttagagacctcatccctttcaattgatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtcccttttcccacccctccctttgtgtcccccgcaggaatgcaagaaaacccccctggagtgctatccctacgccttgcagaacccttgaccacctccaatggagcgctgaccctaaaaatggggggtggtttgaccctggacgaagaaggaaagcttacttcccaaaatattaccagtgttgatcctcctcttaaaaaaacaaaaaacaatatcagtctgcagactgcctccccccttgccgtcagctcgggagccctcacacttttcgctactcctcccctggcagttaatgacaataacctaactgtgcagtctcaggctccccttacactggaaaactcaaaactaagtctggccaccaaaggccccctaaccgtttctgaaggaaaacttgccctagaaacagaggctcccttgcatgcaagcgacagcagtagcctaggccttagtgtaacggccccactgagcattagcagcgacagcctaggactagacttgcaagcgcccattatttctgaaaatggaaaactgggcctaagagtaacaggtcccctaactgtggccagcagtattgatgctttgacagtagccacaggcagcggtattggacttgatagcaacacgcgcctacaggcaaaattggtcgcgcccctaggctttgacaccaatggcaacattaagctcagcacttcgggcggcatgagactgaacaatggcacacttatactagatgtaaactacccatttgaggctcaaggtcaacttagtctaagagtgggttcgggtccactgtatgtagactccaacacacataacctaaccgctagatgccttagagggctatacataacgtcatctaataaccaaaccggcctggaggccaacataaaacttacaaaaggacttgtgtttgatggaaatgccatagcagttaatgttagcaaagggctagaatacagtaccactgaaacagcgcagggtgtaaatcccatacagactaaaataggtttgggcatggaatatgataccaatggagccataaagccaagactaggctctggtttgagctttgataattcaggagctattgtagtgggaaacaaaaatgatgacactcttactctgtggactacaccagacccatctcccaactgtcagattaactcggaaaaagatgctaaactaaccttggtactaaccaagtgcggtagtcaaattgtaggcacagtatctgcctttgctcttaaaggcagccttgccccaattaatggcacagtgagctcagttagtatattcctaagatttaatgaaaatggggtactgatgagcaactcatcgttggaaagccaatactggaattacaggaatggaaattcaactaatgccacaccatatacaaatgcactaggttttatgcctaacctggcagcttatcccaaaggccaggcaacgactgcaaaaagcagcatcattagccaggtttacatgaatggtgacacttccaaacctatgatatttacaataacttttaatgggcttgaaacagaggaaactcaggtcagtacatattccatgacattttcatggaggtggacaaatggagactacgtggggcactattttaaaacaaactcctttactttctcctacattgcccaagaataaagaaagcacagagatgcttgtttttgatttcaaaattgtgtgcttttatttatttcaagcttacagtatttccagtagtcattcgaatagagcttaattaaactgcatgagaacccttccacatagcttaaattagcaccagtgcaaatggagaaaaatcaacatacctttttatccagatatcagagaactctagtggtcagttttcccccaccctcccagctcacagaatacacagtcctttccccccggctggctttaaacaacactatctcattggtaacagacatattcttaggtgtaataatccacacggtctcttggcgggccaaacgctggtcggtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgcagcaacaaggcgcgcagcaactcctgccgccgcctctccgtacggcaggaatgcaacggcgtggtggtctcctccgcgataatccgcaccgctcgcagcatcagcatcctcgtcctccgggcacagcagcgcatcctgatctcactgagatcggcgcagtaagtgcagcacaaaaccaagatgttatttaagatcccacagtgcaaagcgctgtacccaaagctcatggcgggaaggacagcccccacgtgaccatcataccagatcctcaggtaaatcaaatgacgacctctcataaacacgctggacatgtacatcacctccttgggcatgtgctgattcaccacctctcgataccacaagcatcgctgattaattaaagacccctcgagcaccatcctgaaccaggaagccagcacctgaccccccgccaggcactgcagggaccccggtgaatcgcagtggcagtgaagactccagcgctcgtagccgtgaaccatagagctggtcattatatccaaattggcacaacacagacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgttcggtgtagtagttgtaatacagccactccctgagaccgtcaaggcgctccctggcgtccggatctatgacaacaccgtcctgcagcgccgccctgatgacatccaccaccgtagagtatgccaagcccagccaggaaatgcattcactttgacagcgagagataggaggagcggggagagatggaagaaccatgatagtaaagagaacttttattccaatcgatcttctaagatatcaaagtggagatctataagatgacactggtctcctccgctgagtcgatcaaaaataacagctaaaccacaaacaacacgattggtcaaatgctccacaagggcctgcagcataaaattgcctcggaactccaccgcaagcataacatcaaagccaccgcctctatcgtgatcaagaataaaaaccccacagctatccaccagacccatatagttttcatctctccatcgtgaaaaaagatttacaagctcctcctttaaatcacctccaaccaattgaaaaagttgaaccagaccgccctccaccttcattttcagcaagcgtatcatgattgcaaaaattcaggctcctcagacacctgtataagattgagaagcggaacgttaacatcgatgtttcgctcgcgtaaatcacgcctcagtgcaagcataatataatcccacaggtcggagcggatcagcgaggacacctccccgccaggaaccaactcaacggagcctatgctgattataatacgcatattcggagctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacgaccacagaaaaatgcacaatttttctctcaaacatgactgcgagccctgcaaaaaataaaaaagaaacattacacaagagtagcctgtcttacgatgggatagactactctaaccaacataagacgggccacaacatcgcccgcgtggccataaaaaaaattgtccgtgtgattaaaaagaagcacagatagctggccagtcatatccggagtcatcacgtgtgaacccgtgtagacccccgggttggacacatcggccaaagaaagaaagcggccaatgtacccaggaggaattataacactaagacgaagatacaacagaataaccccatgagggggaataacaaagttagtaggtgaataaaaacgataaacacccgaaactccctcctgcgtaggcaaaatagcaccctccccttccaaaacaacatatagcgcttccacagcagccatgacaaaagactcaaaacactcaaaagactcagtcttaccaggaaaataaaagcactctcacagcaccagcactaatcagagtgtgaaaagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccgctttctcacgatacgtcacttccgcaagaaaagcaaaactacatttcccacatgtgtaaaaacgaaaccccgccccttctaaccgcccacaacttacatcatcaaaacgtaaagtcctacgtcacccgccccgcctctccccgcccacctcattatcatattggccacaatccaaaataaggtatattat

SEQ ID NO: 22 - DNA, 37058 bp, Gorilla beringei graueri
ataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcaccgtcatttgacgcggagggtatttaaacccgctgcgctcctcaagaggccactcttgagtgccagcgagaagagttttctcctctgctccgcttcggtgatcgaaaaatgagacacatagcctgcactccgggtcttttgtccggtcgggcggcggccgagcttttggacgctttgatcaatgatgtcctgagcgatgattttccgtctactacccactttagcccacctactcttcacgaactgtacgatctggatgtactggtggatgtgaacgatcccaacgaggaggcggtttctgcgttttttcccgagtctgcgctgttggccgctcaggagggatttgacctacacactccgccgcctattttagagtctccgctgccggagcccagtggtataccttatatgcctgaactgcttcccgaagtggtagacctgacctgccacgagcctggctttccgcccagcgacgatgatggtgagccttttgttttagactttgctgagatacctgggcacggttgcaggtcttgtgcatatcatcagagggttaccggagaccccgaggttaagtgttcgctgtgctatatgaggatgacctcttcctttatctacagtaagtttttgtctaggtgggcttttgggtaggtgggttttgtgtcagaacaggtgtaaacgttgcttgtgttttttgtacctgtaggtccggtgtccgagccagacccggagcccgaccgcgatcccgagccggatcccgagcctcctcgcaggacaaggaaactaccttccattctgtgcaagtctcagacacctgtaaggaccagcgaggcagacagcaccgactctggcacttctacctctccccctgaaattcacccagtggttcctctgggtatacataaacctgttgctgttagagtttgcgggcgacgccctgcagtacagtgcattgaggacttgcttcacgatcccgaggaacctttggacttgagccttaaacgccctaggcaataaaccccacctaagtaataaaccccacctaagtaataaaccctgccgcccttggttattgagatgacgcccaatgtttgcttttgaatgacttcatgtgtgtaataaaagtgagtgtgatcataggtctcttgtttgtctgggcggggcttaagggtatataagtttctcggggctaaacttggttacacttgaccccaatggaggcgtgggggtgcttggaggagtttgcggacgtgcgccgtttgctggacgagagctctaaccatacctatactatttggaggtatctgtggggctctactcaggccaagttggtctccagaattaagcaggattacaagtgcgattttgaagagctttttagttcctgcggtgagcttttgcaatccttgaatctgggccatcaggctattttccaggaaaaggttctctcgactttggatttttccactcccgggcgcaccgccgcttgtgtggcttttgtgtcttttgtgcaagataaatggagcgaggagacccacctgagtcacggctacgtactggatttcatggcgatggctctttggagggctcacaacaaatggaagattcagaaggaactgtacggttccgccctacgtcgtccacttttgtcgcgacaggggctgaggtttcccgaccatcggcagcatcagaatctggaagacgagtcggaggagcgagcggaggagaagatcagcttgagagccggcctggaccctcctcaggaggaatgaatctcccgcaggtggttgacctgtttccagaactgagacgggtcctgactatcagggaggatggtcagtttgtgaagaagtttaagagggatcggggtgagggagatgatgaggcggctagcaatttagcttttagtctgatgactcgccaccgaccggaatgtattacctatcagcagattaaggagagttgtgccaacgagctggatcttttgggtcagaagtatagcatagaacagcttaccacttactggcttcagcctggggatgattgggaagaggcgatcagggtgtatgcaaaggtggccctgcggcccgattgcaagtataagattactaagttggttaatattagaaactgctgctatatttctgggaacggggccgaagtggagatagatactcaggacagggtggcttttaggtgttgcatgataaacatgtggcccgggatactggggatggatggggtggtgttcatgaatgtgaggtttacgggccccaactttaatggcacggtgttcatgggcaacaccaacttgctcctgcatggtgcgagtttctatgggtttaataacacctgtatagaggcctggaccgatgtaaaggttcgaggttgttccttttatagctgttggaaggcggtggtgtgtcgccctaaaagcaggggttctgtgaaaaaatgcttgtttgaaaggtgcaccttaggcatcctctctgagggcaactccagggtgcgccataatgtggcttcgaactgcggttgcttcatgcaagtgaagggggtgagcgttatcaagcataactcggtgtgtggaaactgcgaggatcgcgcctcccagatgctgacctgctttgatggtaactgtcacctgttgaagaccattcatataagcagccaccccagaaaggcctggcccgtgtttgagcataacatcctgacccgctgctccttgcatctgggggtcaggaggggtatgttcctgccttaccagtgtaactttagccacactaaaatcctgctggaacccgagtgtatgaccaaggtcagcctaaatggcgtgtttgatgcgactctgagaatctggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgcaccagggccgagtttgggtctagcgatgaggataccgattgaggtgggtaaggtgggcgtggctagaagggtggggcgtgtataaattgggggtctaagggtctctctgttttgtcttgcaacagccgccgccatgagcgacaccggcaacagctttgatggaagcatctttagcccctatctgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcagcgcggcctctcgcgcgtctgctcgggatgagaaactgaccgctctgctgcttaaactggaagacttgacccgggagctgggtcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataagacatctttacaaatcgggggcggagggtcccggactggggtatgatggtaccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagcctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcgccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtcctgaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaaggaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacgggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcctcctggagatctcctcgtccggcgcgctccacggtggccgccaggtcgttggagatgcgacccatgagctgcgagaaggcgttgagcccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacgccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcataaggcggtggtatccgtagatgtacctggacatccaggtgatgccggcggcggtggtggtggcgcgcgcgtagtcgcggacccggttccagatgtttcgcaggggcaagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgagggccgtggcagccccgtcctcaggaccccgccagccgacttctccagttacgggagcgagccccttttgtttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtgaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggacgatgaccaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgagtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggatgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttgaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggaaacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacgcaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcattaaccgcctgatggactacttgcatcgggcggcggccgtgaaccccgagtacttcactaatgccattctgaatccccactggatgccccctccgggtttctacaacggggacttcgaggtgcccgaggttaacgacgggttcctctgggatgacatggatgacagtgtgttctcacccaacccgctgcgcgccgcgtctctgcgattgaaggagggttctgacagggaaggaccgaggagtctggcctcctccctggctctgggagcggtgggcgcggcggcgcggggcagtagccccttccccagcctggcagactctctgaacagcgggcgggtgagcaggccccgcttgctaggcgaggaggagtatctgaacaactccctgctgcagcccgcgagggacaaaaacgctcagcggcagcagtttcccaacaatgggatagagagcctggtggacaagatgtccagatggaagacgtatgcgcaggagtacaaggagtgggaggaccgccagccgcggcccctgccgccccctaggcagcgctggcagcggcgcgcgtccaaccgccgctggaggcaggggcccgaggacgatgatgactctgcagatgacagcagcgtgctggacctgggcgggagcgggaaccccttttcgcacctgcgcccccgcctgggcaagatgttttaaaagagaaaaaataaaaactcaccaaggccatggcgacgagcgttggttttttgttcccttccttagtatgcgacgcgcggcgatgttcgaggaggggcctcccccctcttacgagagcgcgatgggattttctcctgcgacgcccctacagcctccctacgtgcctcctcggtacctgcaacctaccgggggaagaaatagcatctgttactctgagctgcagcccctgtatgacaccaccaaagtgtacctggtggacaacaagtctgcggacgtggcctccctgaactaccagaacgaccacagcgattttttgaccaccgtgatccaaaacaatgacttcaccccaaacgaggccagcacccagaccataaacctggacaacaggtcgcactggggcggtgatctgaagaccatcttgcacaccaacatgcccaacgtgaatgagtttatgtttactaactcttttaaggcgcgggtaatggtggcgcgcgacgataagggagtgcctaaatacgagtgggtggactttacactgcccgagggcaactactccgagatcatgactcttgacctgatgaacaacgcgatcgtggagcactacttgaaagtaggcaggcagaacggggtaaaagaaagcgatattggagttaagtttgacaccaggaactttcgcctgggatgggaccccgagacggggttggttatgcccggggtttacactaatgaagcttttcaccccgatatagtgctcttgcccggatgcggggtggacttcacccaaagccggctgagcaacctgctgggcattcgaaagcgccagccattccaggaggggtttcaaatcacttatgagcatttggaagggggcaacattccggcgcttctggatttggtcgcctacgaggagagtttgaaatccgaggaaagcggggataacactgacaagggcggcgaggagcaagccggcgatggcgacactgcttcggtagaaaacgaaagtgcgtccgtggtggaggcggcggcggtagcgaccgcagagccggagaccgtagaggaggatatgaatgatagcgcaatcagaggagactcgtttattccccggggcgaagaaaagaaggcggaggctgcggcagcagtcgaagcagagcccaaagtcgagtcggagatcatggaggaggatttgaatgataacgcgatcagaggtgatacgtttgtgccgcggggcgaagaaaaaaaagcggaggcggaggccgcggctgaggaggcggccgaggctgtggcagccaccgcggcggtgactgaaacaactgaggagcaggttcaggccgagcaggttcaaaagaagcccgtgattaaagccctaacacaagatagcaaggagcgcagttacaacttgattcccggtagtactgacaccgagtaccgcagctggtacctggcatacaactacggcgacccggtcaaaggggtgcgctcgtggactctgctttgcacgccggacgtcacctgcggctccgagcagatgtactggtcgttgccaaacatgatgcaagacccggtgaccttccgctccacgcggcaggttaacaacttcccggtggtgggcgccgaactgctgcccgtgcactccaagagcttttacaacgagcaggccgtgtactcccagctgatccgccaggccacctctctgacccacgtgttcaatcgctttcccgagaaccagattttggcgcgcccgccggcccccaccatcactaccgtcagtgaaaacgttcctgctctcacagatcacgggacgctaccgctgcgcaacagcatctcaggagtccagcgagtgaccattactgacgccagacgccggacctgcccctacgtttacaaggccttgggcatagtctcgccgcgcgtcctctccagccgcactttttaaaacacatattcacccacgcttcaaagattatgtctatacttatctcacccagcaataacaccggctgggggctgcgcgcgcccagcaagatgtttggaggggcgagaaaacgttccgagcagcacccagtgcgcgtgcgcggccactaccgcgcgccctggggagcgcacaagcgcgggcgcgcagggcgcaccactgtggacgacgccattgactccgtagtggagcaggcgcgccactacacacccggcgcgccgtccgcccccgccgtgtccaccgtggacgaggcgatcgaaagcgtggtacagggcgcgcggcactatgccaaccttaaaaatcgccgccgtcgcgtggcccgccgccatcgccggagaccccgggccaccgccgccgcgcgccttgctaaggctctactcaggcgcgccaggcgaactggccgccgggccgccatgagggccgcacggcgggctgccgccagtgcggccgccgcggccccacgggcacgaaggcgcgcggccgctgccgccgccgccgccatttccagcttggcctcaacgcggcgcggtaacatatactgggtgcgcgactcgataaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgatgacgaggcggtggagtttgtccgccgcatggcacccaggcgccccgtgcagtggaagggtcggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtgaccctgcaacaggtgctgcctttgagcgcgcccagcgagcataagcgagggttgaagcgcgagggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcagcggccagcgccaccaccggcaccgcttcggtagaggtgcagacggacccctggctacccgccgccgctgtcgccgccgccgccgccccccgttctcgcgggcgcaagagaaattatccagtggccagcgcgctcatgccccagtacgcactgcatccatccatcgcgcccacccccggctaccgcgggtattcgtaccgcccgcgcagatcggccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcatttttttggaggaaaaaataaaaaagtctagactctcacgctcgcttggtcctgtgactattttgtagaaaaaagatggaagacatcaactttgcgtcgctggccccgcgtcatggctcgcgcccgttcatgggagactggacagatatcggcaccagcagtatgagcggtggcgccttcagctggggcagtctgtggagcggccttaaaaattttggttccaccattaaaaactatggcaacaaagcgtggaacagcagcacgggccagatgctaagagacaagttgaaagagcagaacttccaggagaaggtggcgcagggcctggcctctggcatcagcggggtggtggacatagctaaccaggccgtgcagaaaaagataaacagtcatctggacccccgccctcaggtggaggaaacgcctccagccatggagacggtgtttcccgagggcaaaggcgaaaagcgcccgcggcccgacagggaagagaccctggtgtcacacaccgaggagccgccctcttacgaggaggcactcaaggccggcctgcccaccactcgccccgtagctcccatggccacaggtgtggtgggccataaacaacacacccccgcaacactagatctgcccccgccgtccgagccgccgcgtcagccaaagacggcgacggtgcccgctccctccacttccgccgccaacagagtgtccctgcgccgcactacgggcgcccctcggggaccgcgactgagcggcaactggcagagcacactgaacagcattgtgggcctgggagtgaaaagtgtgaagcgccgccgttgctactgaatgagcaagctagctaacgtgttatatgtgtgtatgcgtcctatgtcgccgccagaggagctgttgagccgcccgcgccgtctgcactccagcgaatttcaagatggcgaccccttcgatgatgccacagtggtcgtacatgcacatctcgggccaggacgcctcggagtacctgagccccgggctggtgcagttcgcccgcgccaccgacagctacttcagcctaagtaacaaatttaggaaccctacggtggcacccacccacgatgtgaccacggaccggtcgcagcgcctgacgctgcggtttatccccgtggatcgggaggacactgcctactcttacaaggcgcgcttcacgctagccgtgggcgacaaccgcgtgctggacatggcctccacctactttgatatccggggtgtgctggacaggggtcccacctttaagccctactcgggcactgcctacaactccctggctcctaaaggcgctcccaattcttgcgagtgggatgaaaaaactaatactgctgaagcagccattgaaaatgaagaagagctggcggatgagccagaagagcaagcagaagaggctataaaaaccaatgtgtttgcccaggcgccatattctggcaatgcaatttccaaagaaggaatacaagtaggcatagaaggcattggagagcaagtaaaagccgtatacgcagacaaaacctaccagccggaacctcaggttggagaaactcaatggaatgagactgaaataaatcatggagcaggaagggtgctgaagaagaccactcccatgaagccttgctatggttcttatgctaaacctactaatgaatatggaggccagggcatccttgtagaaaaaaatggcaaaatggaaagccaggtggaaacacagttttttgctcttgacggtgaaaatgataatagtccaaaagtggtgttgtatagcgaagatgtaaacttggatactcctgacacacacctatcatacaaacctagcgcccaagatgtaaactctaaagaaatgttgggccaacaggccatgcccaacaggccaaatcttattgcttttagggacaactttattggacttatgtactacaacagcactggcaacatgggagtgctggcaggacaggcctcccaactaaatgccgtggtagacttgcaagacagaaacacagagttgtcataccagctgatgcttgattccattggagacagatcaagatattttgccatgtggaaccaggcggttgatagttacgatccagatgttagaattattgaaaaccatggcacagaggatgaacttccaaactactgttttcctttgggaggaatatttaatactcagagttttaaaaaggtaaaacctggaacggataacggatgggaaacagatgatgacttttcagataaaaatgaaataagagttggcaacaactttgccatggagatcaatatccaggcaaacctgtggagaagcttcttgtattccaatgtggctctctacctgccagataagatgaagtactctccaaccaacatagacatttccaccaacactaacacctatgactacatgaacaaaagagtggcgcctccaggcctggtggactgctatgtcaatctgggggccaggtggtcccttgatgtaatggataacatgaacccctttaaccaccaccgcaatgcgggcctgcgataccgttccatgcttctgggtaacggccgctacgtgcccttccacatccaggtgccccaaaagttctttgccatcaaaagccttctactcttgcctggctcgtacacctacgaatggaatttcagaaaggatgtgaacatggtcctacagagctctctgggcaacgaccttagggtggatggggccagcatcaagtttgacagcatcaccctttatgctacctttttccccatggcccacaacaccgcttccacgcttgaggccatgctcagaaacgacaccaacgaccagtccttcaatgactacctctctggggccaacatgctctaccccatccccgccaacgctaccaacgtgcccatctccattccctctcgcaactgggccgccttcagaggctgggcatttacccgccttaagaccaaggagaccccctccctgggctcgggttttgacccctactttgtctactcgggatccatcccctacctggatggcaccttctacctcaaccacacttttaagaagatatccatcatgtatgactcctctgtcagctggccgggcaacgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccgttggcatcactcaccagcacaacaactcgggattcgtgggctacctggcacccaccatgcgcgagggacaggcctaccccgccaacttcccctaccccttgataggcaagaccgcggtcgacagcgtcacccagaaaaagttcctctgcgaccgcaccctctggcgcatccccttttctagcaacttcatgtccatgggcgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacttgctacctctttgacccttttggcttctccgatcagcgcctcaagcagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcgcatccggggggccacctctttctgccacttgcaagaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggttcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattatgcacgctggccagcaggctctcgtcgctgatcatgtcgctgtccagatcctccgcgttgctcagggcgaatggggtcatcttgcagacctgcctgcccaggaaaggcggcagcccgggcttgccgttgcagtcgcagcgcaggggcatcagcaggtgcccgcggcccgactgcgcctgcgggtacagcgcgcgcatgaaggcttcgatctgcctgaaagccacctgcgccttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtcccgtgcagacacttcaggtcgccctccgtctgggtgcagcggtgctcccacagcgcgcaaccggtgggctcccaattcttgtgggtcacccccgcgtaggcctgcaggtaggcctgcaagaagcgccccatcatggccacgaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagcgccgcctgctcttcttcgtcttcgctgtctaccactatctctggggaagggcttctccgctctgcggcggtgcgcttcttttttttcttgggagcagccgtgacggagtccgccacggcgacggaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcctctcgagctggtcttggtctcgactggccattgtatcctcctcctcctaggcagagagacataaggagtctatcatgcaagtcgagaaggaggagagcttaaccaccccctctgacaccgccgatgcgcccgccgtcgccgtcgcccccgctgccgccgacgcgcccgccacaccgagcgacacccccgcggacccccccgccgacgcacccctgttcgaggaagcggccgtggagcaggacccgggctttgtctcggcagaggaggatttgcgagaggaggagaataaggagaagaagccctcagtgccaaaagatgataaagagcaagacgagcacgacgcagatgcacaccagggtgaagtcgggcggggggacggagggcatggcggcgccgactacctagacgaagggaacgacgtgctcttgaagcacctgcatcgtcagtgcgccatcgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgccttcgtggtgcccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtgccaaagatctttgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctaaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgcggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgtctggaggagcgcaacctcaaagagctggagaagctcctgcagcgcgcgctcaaagacctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaggaccaatcccgcccgcccaaggcggagctgaccgcctgcgtcatcacccagggcgagatcctaggccaattgcaagccatccaaaaagcccgccaagattttttgctgaagaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcgattaccaccacgccccgcaataatcccaaccccagggagtggcccgcgtccctggtgtatcaggaaattcccggccccaccaccgtactacttccgcgtgattcccaggccgaagtccaaatgactaactcaggggcgcagctcgcgggcggctgtcgtcacagggtgcggccccctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctccggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgagaaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgattttatagaaccccagtgcaatatcacttataaatctgaatataacctctgcactatcctaattaaatgcgttactcaacacgatgaggtaactgttagatacaaagatcaatcaaaaagagacgcactttacagcagctggcaaccaggagatgaacaaaaatacaatgtgaccgtcttccagggcaaactctccaaaacttacaattacactttcccattcgaggagatgtgtgagtttgtcatgttcatgtcaaagcagtacaagatgtggcctccgactccccagggctgtgtggaaaatccaggctctttctgcatgatctctctctgtgtaactgtgctggcactaatactcacgcttttgtatatcagatttaaatcaaggcaaagcttcatcgatgaaaagaaaatgccttaatcgcttttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatttaaccttgattgatgttcaattgctggatgcgggctactattatgggcagctgggtacaatcgttaattactggagaccccacaaagattacatgcttcacgtagtaaagggtccccttagcagcccgaccactaccaccacctctaccacacccactaccaccactactcccatcaccagcactgccacccagcctcctcatagcagaacaaccacttttatcaattccaagtcccactccccccacattgccggcgggccctccgcctcaaactccgagaccaccgagatctgcttctgcaaatgctctgacgccattgcccaggatttggaagaccacgaggaagatgagcatgacttcgcagatgcatgccaggcatcaggggcagaagcactgccggtggccctcaaacagtatgcagactcccataccacccccgatcttccaccgccttcccagaagccaagtttcctgggggaaaatgaaacactgcctctctccatacttgctttgacatctgttgctattctgactgctctgctggtgctcctatgctctatatgctacctgatctgctgcaggaagaaaaaatctcacggccatgctcaccagccgcttatgcacttcccttaccctccagagttgggcgaccacaaactttaagtctgcagtagctatctgcccatcccttgtcagtcgacagcgatgagccccactaatctaacggcctctggacttacaacattgtctcttaatgagaccaccgctcctcaagacctgtacgatggtgtctccgcgctggttaaccagtgggatcacctgggcatatggtggctcctcataggagcagtgaccctgtgcctaatcctggtctggataatctgctgcatcaaaagcagaagacccaggcggcggcccatctacaggcccttcgtcatcacacctgaagatgatgatggcaccacgtccaggctgcagagcctaaagcagctactcttctcttttacagcatggtaaattgaacatgcctcgcattttcatctacttgtttcttcttccactctttttgggctcttctacattggcagctgtgtcccacatcgaggtagactgcatctcgcccttctcagtctacttactcttcggctttgtcatttgcaactttgtctgcagcgttatcactgtagtgatctgcttcatacagtgcatcgactacgtctgcgtacgggtggcctattttagacaccacccccagtatcgcaacagggacatagcggctctcctaagacttgtttaaatcatgcccaaattaactgtgattgctcttctgattatctgctgcgtcctagccgcgattgggactcagcctactaccaccaccaccagcgctcccagaaagagacatgtttcctgcagcttcaaacgtccctggaatataccccaatgctttactgatgaacctgaaatctctttggcttggtacttcagcgtcaccgcccttctcatcttctgcagtacggttattgcccttgccatttacccttcccttgacctgggctggaatgctgtcaactctatggaatatcccaccttcccagaaccagacctgccagacctggttgttctaaacgcgtttcctcctcctcccgttcaaaatcagtttcgccctccgtccccgacgcccactgaggtcagctactttaatctaacaggcggagatgactgaaaacctagacctagaaatggacggcctctgcagcgaacaacgcatactagagaggcgccggcaaaaagcagagctcgagcgtcttaaacaagagctccaagacgcggtggccatacaccagtgcaaaaaaggtgtcttctgtctagtgaaacaggccacgctcacctatgaaaaaacaggtgacacccaccgcctaggatacaagctgcccacacaacgccagaagttcgcccttatgataggcgaacaacccatcaccgtcacccagcactctgtggagacagaaggctgcatacacgctccctgcaggggcgctgactgtctctacaccttgatcaaaaccctctgcggccttagagacctcatccctttcaattgatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtcccttttcccacccctccctttgtgtcccccgcaggaatgcaagaaaacccccctggagtgctatccctacgccttgcagaacccttgaccacctccaatggagcgctgaccctaaaaatggggggtggtttgaccctggacgaagaaggaaagcttacttcccaaaatattaccagtgttgatcctcctcttaaaaaaacaaaaaacaatatcagtctgcagactgcctccccccttgccgtcagctcgggagccctcacacttttcgctactcctcccctggcagttaatgacaataacctaactgtgcagtctcaggctccccttacactggaaaactcaaaactaagtctggccaccaaaggccccctaaccgtttctgaaggaaaacttgccctagaaacagaggctcccttgcatgcaagcgacagcagtagcctaggccttagtgtaacggccccactgagcattagcagcgacagcctaggactagacttgcaagcgcccattatttctgaaaatggaaaactgggcctaagagtaacaggtcccctaactgtggccagcagtattgatgctttgacagtagccacaggcagcggtattggacttgatagcaacacgcgcctacaggcaaaattggtcgcgcccctaggctttgacaccaatggcaacattaagctcagcacttcgggcggcatgagactgaacaatggcacacttatactagatgtaaactacccatttgaggctcaaggtcaacttagtctaagagtgggttcgggtccactgtatgtagactccaacacacataacctaaccgctagatgccttagagggctatacataacgtcatctaataaccaaaccggcctggaggccaacataaaacttacaaaaggacttgtgtttgatggaaatgccatagcagttaatgttagcaaagggctagaatacagtaccactgaaacagcgcagggtgtaaatcccatacagactaaaataggtttgggcatggaatatgataccaatggagccataaagccaagactaggctctggtttgagctttgataattcaggagctattgtagtgggaaacaaaaatgatgacactcttactctgtggactacaccagacccatctcccaactgtcagattaactcggaaaaagatgctaaactaaccttggtactaaccaagtgcggtagtcaaattgtaggcacagtatctgcctttgctcttaaaggcagccttgccccaattaatggcacagtgagctcagttagtatattcctaagatttaatgaaaatggggtactgatgagcaactcatcgttggaaagccaatactggaattacaggaatggaaattcaactaatgccacaccatatacaaatgcactaggttttatgcctaacctggcagcttatcccaaaggccaggcaacgactgcaaaaagcagcatcattagccaggtttacatgaatggtgacacttccaaacctatgatatttacaataacttttaatgggcttgaaacagaggaaactcaggtcagtacatattccatgacattttcatggaggtggacaaatggagactacgtggggcactattttaaaacaaactcctttactttctcctacattgcccaagaataaagaaagcacagagatgcttgtttttgatttcaaaattgtgtgcttttatttatttcaagcttacagtatttccagtagtcattcgaatagagcttaattaaactgcatgagaacccttccacatagcttaaattagcaccagtgcaaatggagaaaaatcaacatacctttttatccagatatcagagaactctagtggtcagttttcccccaccctcccagctcacagaatacacagtcctttccccccggctggctttaaacaacactatctcattggtaacagacatattcttaggtgtaataatccacacggtctcttggcgggccaaacgctggtcggtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgcagcaacaaggcgcgcagcaactcctgccgccgcctctccgtacggcaggaatgcaacggcgtggtggtctcctccgcgataatccgcaccgctcgcagcatcagcatcctcgtcctccgggcacagcagcgcatcctgatctcactgagatcggcgcagtaagtgcagcacaaaaccaagatgttatttaagatcccacagtgcaaagcgctgtacccaaagctcatggcgggaaggacagcccccacgtgaccatcataccagatcctcaggtaaatcaaatgacgacctctcataaacacgctggacatgtacatcacctccttgggcatgtgctgattcaccacctctcgataccacaagcatcgctgattaattaaagacccctcgagcaccatcctgaaccaggaagccagcacctgaccccccgccaggcactgcagggaccccggtgaatcgcagtggcagtgaagactccagcgctcgtagccgtgaaccatagagctggtcattatatccaaattggcacaacacagacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgttcggtgtagtagttgtaatacagccactccctgagaccgtcaaggcgctccctggcgtccggatctatgacaacaccgtcctgcagcgccgccctgatgacatccaccaccgtagagtatgccaagcccagccaggaaatgcattcactttgacagcgagagataggaggagcggggagagatggaagaaccatgatagtaaagagaacttttattccaatcgatcttctaagatatcaaagtggagatctataagatgacactggtctcctccgctgagtcgatcaaaaataacagctaaaccacaaacaacacgattggtcaaatgctccacaagggcctgcagcataaaattgcctcggaactccaccgcaagcataacatcaaagccaccgcctctatcgtgatcaagaataaaaaccccacagctatccaccagacccatatagttttcatctctccatcgtgaaaaaagatttacaagctcctcctttaaatcacctccaaccaattgaaaaagttgaaccagaccgccctccaccttcattttcagcaagcgtatcatgattgcaaaaattcaggctcctcagacacctgtataagattgagaagcggaacgttaacatcgatgtttcgctcgcgtaaatcacgcctcagtgcaagcataatataatcccacaggtcggagcggatcagcgaggacacctccccgccaggaaccaactcaacggagcctatgctgattataatacgcatattcggagctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacgaccacagaaaaatgcacaatttttctctcaaacatgactgcgagccctgcaaaaaataaaaaagaaacattacacaagagtagcctgtcttacgatgggatagactactctaaccaacataagacgggccacaacatcgcccgcgtggccataaaaaaaattgtccgtgtgattaaaaagaagcacagatagctggccagtcatatccggagtcatcacgtgtgaacccgtgtagacccccgggttggacacatcggccaaagaaagaaagcggccaatgtacccaggaggaattataacactaagacgaagatacaacagaataaccccatgagggggaataacaaagttagtaggtgaataaaaacgataaacacccgaaactccctcctgcgtaggcaaaatagcaccctccccttccaaaacaacatatagcgcttccacagcagccatgacaaaagactcaaaacactcaaaagactcagtcttaccaggaaaataaaagcactctcacagcaccagcactaatcagagtgtgaaaagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccgctttctcacgatacgtcacttccgcaagaaaagcaaaactacatttcccacatgtgtaaaaacgaaaccccgccccttctaaccgcccacaacttacatcatcaaaacgtaaagtcctacgtcacccgccccgcctctccccgcccacctcattatcatattggccacaatccaaaataaggtatattat

SEQ ID NO: 23 - DNA, 37057 bp, Gorilla beringei graueri
ataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcaccgtcatttgacgcggagggtatttaaacccgctgcgctcctcaagaggccactcttgagtgccagcgagaagagttttctcctctgctccgcttcggtgatcgaaaaatgagacacatagcctgcactccgggtcttttgtccggtcgggcggcggccgagcttttggacgctttgatcaatgatgtcctgagcgatgattttccgtctactacccactttagcccacctactcttcacgaactgtacgatctggatgtactggtggatgtgaacgatcccaacgaggaggcggtttctgcgttttttcccgagtctgcgctgttggccgctcaggagggatttgacctacacactccgccgcctattttagagtctccgctgccggagcccagtggtataccttatatgcctgaactgcttcccgaagtggtagacctgacctgccacgagcctggctttccgcccagcgacgatgatggtgagccttttgttttagactttgctgagatacctgggcacggttgcaggtcttgtgcatatcatcagagggttaccggagaccccgaggttaagtgttcgctgtgctatatgaggatgacctcttcctttatctacagtaagtttttgtctaggtgggcttttgggtaggtgggttttgtgtcagaacaggtgtaaacgttgcttgtgttttttgtacctgtaggtccggtgtccgagccagacccggagcccgaccgcgatcccgagccggatcccgagcctcctcgcaggacaaggaaactaccttccattctgtgcaagtctcagacacctgtaaggaccagcgaggcagacagcaccgactctggcacttctacctctccccctgaaattcacccagtggttcctctgggtatacataaacctgttgctgttagagtttgcgggcgacgccctgcagtacagtgcattgaggacttgcttcacgatcccgaggaacctttggacttgagccttaaacgccctaggcaataaaccccacctaagtaataaaccccacctaagtaataaaccctgccgcccttggttattgagatgacgcccaatgtttgcttttgaatgacttcatgtgtgtaataaaagtgagtgtgatcataggtctcttgtttgtctgggcggggcttaagggtatataagtttctcggggctaaacttggttacacttgaccccaatggaggcgtgggggtgcttggaggagtttgcggacgtgcgccgtttgctggacgagagctctaaccatacctatactatttggaggtatctgtggggctctactcaggccaagttggtctccagaattaagcaggattacaagtgcgattttgaagagctttttagttcctgcggtgagcttttgcaatccttgaatctgggccatcaggctattttccaggaaaaggttctctcgactttggatttttccactcccgggcgcaccgccgcttgtgtggcttttgtgtcttttgtgcaagataaatggagcgaggagacccacctgagtcacggctacgtactggatttcatggcgatggctctttggagggctcacaacaaatggaagattcagaaggaactgtacggttccgccctacgtcgtccacttttgtcgcgacaggggctgaggtttcccgaccatcggcagcatcagaatctggaagacgagtcggaggagcgagcggaggagaagatcagcttgagagccggcctggaccctcctcaggaggaatgaatctcccgcaggtggttgacctgtttccagaactgagacgggtcctgactatcagggaggatggtcagtttgtgaagaagtttaagagggatcggggtgagggagatgatgaggcggctagcaatttagcttttagtctgatgactcgccaccgaccggaatgtattacctatcagcagattaaggagagttgtgccaacgagctggatcttttgggtcagaagtatagcatagaacagcttaccacttactggcttcagcctggggatgattgggaagaggcgatcagggtgtatgcaaaggtggccctgcggcccgattgcaagtataagattactaagttggttaatattagaaactgctgctatatttctgggaacggggccgaagtggagatagatactcaggacagggtggcttttaggtgttgcatgataaacatgtggcccgggatactggggatggatggggtggtgttcatgaatgtgaggtttacgggccccaactttaatggcacggtgttcatgggcaacaccaacttgctcctgcatggtgcgagtttctatgggtttaataacacctgtatagaggcctggaccgatgtaaaggttcgaggttgttccttttatagctgttggaaggcggtggtgtgtcgccctaaaagcaggggttctgtgaaaaaatgcttgtttgaaaggtgcaccttaggcatcctctctgagggcaactccagggtgcgccataatgtggcttcgaactgcggttgcttcatgcaagtgaagggggtgagcgttatcaagcataactcggtgtgtggaaactgcgaggatcgcgcctcccagatgctgacctgctttgatggtaactgtcacctgttgaagaccattcatataagcagccaccccagaaaggcctggcccgtgtttgagcataacatcctgacccgctgctccttgcatctgggggtcaggaggggtatgttcctgccttaccagtgtaactttagccacactaaaatcctgctggaacccgagtgtatgaccaaggtcagcctaaatggcgtgtttgatgcgactctgagaatctggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgcaccagggccgagtttgggtctagcgatgaggataccgattgaggtgggtaaggtgggcgtggctagaagggtggggcgtgtataaattgggggtctaagggtctctctgttttgtcttgcaacagccgccgccatgagcgacaccggcaacagctttgatggaagcatctttagcccctatctgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcggcgcggcctctcgcgcgtctgctcgggatgagaaactgaccgctctgctgcttaaactggaagacttgacccgggagctggctcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataagacatctttacaaatcgggggcggagggtcccggactggggtatgatggtaccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagcctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcgccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtcctgaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaaggaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacgggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcctcctggagatctcctcgtccggcgcgctccacggtggccgccaggtcgttggagatgcgacccatgagctgcgagaaggcgttgagcccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacgccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcataaggcggtggtatccgtagatgtacctggacatccaggtgatgccggcggcggtggtggtggcgcgcgcgtagtcgcggacccggttccagatgtttcgcaggggcaagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgagggccgtggcagccccgtcctcaggaccccgccagccgacttctccagttacgggagcgagccccttttgtttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtgaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggacgatgaccaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgagtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggatgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttgaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggaaacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacgcaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcattaaccgcctgatggactacttgcatcgggcggcggccgtgaaccccgagtacttcactaatgccattctgaatccccactggatgccccctccgggtttctacaacggggacttcgaggtgcccgaggttaacgacgggttcctctgggatgacatggatgacagtgtgttctcacccaacccgctgcgcgccgcgtctctgcgattgaaggagggttctgacagggaaggaccgaggagtctggcctcctccctggctctgggagcggtgggcgcggcggcgcggggcagtagccccttccccagcctggcagactctctgaacagcgggcgggtgagcaggccccgcttgctaggcgaggaggagtatctgaacaactccctgctgcagcccgcgagggacaaaaacgctcagcggcagcagtttcccaacaatgggatagagagcctggtggacaagatgtccagatggaagacgtatgcgcaggagtacaaggagtgggaggaccgccagccgcggcccctgccgccccctaggcagcgctggcagcggcgcgcgtccaaccgccgctggaggcaggggcccgaggacgatgatgactctgcagatgacagcagcgtgctggacctgggcgggagcgggaaccccttttcgcacctgcgcccccgcctgggcaagatgttttaaaagagaaaaaataaaaactcaccaaggccatggcgacgagcgttggttttttgttcccttccttagtatgcgacgcgcggcgatgttcgaggaggggcctcccccctcttacgagagcgcgatgggattttctcctgcgacgcccctacagcctccctacgtgcctcctcggtacctgcaacctaccgggggaagaaatagcatctgttactctgagctgcagcccctgtatgacaccaccaaagtgtacctggtggacaacaagtctgcggacgtggcctccctgaactaccagaacgaccacagcgattttttgaccaccgtgatccaaaacaatgacttcaccccaaacgaggccagcacccagaccataaacctggacaacaggtcgcactggggcggtgatctgaagaccatcttgcacaccaacatgcccaacgtgaatgagtttatgtttactaactcttttaaggcgcgggtaatggtggcgcgcgacgataagggagtgcctaaatacgagtgggtggactttacactgcccgagggcaactactccgagatcatgactcttgacctgatgaacaacgcgatcgtggagcactacttgaaagtaggcaggcagaacggggtaaaagaaagcgatattggagttaagtttgacaccaggaactttcgcctgggatgggaccccgagacggggttggttatgcccggggtttacactaatgaagcttttcaccccgatatagtgctcttgcccggatgcggggtggacttcacccaaagccggctgagcaacctgctgggcattcgaaagcgccagccattccaggaggggtttcaaatcacttatgagcatttggaagggggcaacattccggcgcttctggatttggtcgcctacgaggagagtttgaaatccgaggaaagcggggataacactgacaagggcggcgaggagcaagccggcgatggcgacactgcttcggtagaaaacgaaagtgcgtccgtggtggaggcggcggcggtagcgaccgcagagccggagaccgtagaggaggatatgaatgatagcgcaatcagaggagactcgtttattccccggggcgaagaaaagaaggcggaggctgcggcagcagtcgaagcagagcccaaagtcgagtcggagatcatggaggaggatttgaatgataacgcgatcagaggtgatacgtttgtgccgcggggcgaagaaaaaaaagcggaggcggaggccgcggctgaggaggcggccgaggctgtggcagccaccgcggcggtgactgaaacaactgaggagcaggttcaggccgagcaggttcaaaagaagcccgtgattaaagccctaacacaagatagcaaggagcgcagttacaacttgattcccggtagtactgacaccgagtaccgcagctggtacctggcatacaactacggcgacccggtcaaaggggtgcgctcgtggactctgctttgcacgccggacgtcacctgcggctccgagcagatgtactggtcgttgccaaacatgatgcaagacccggtgaccttccgctccacgcggcaggttaacaacttcccggtggtgggcgccgaactgctgcccgtgcactccaagagcttttacaacgagcaggccgtgtactcccagctgatccgccaggccacctctctgacccacgtgttcaatcgctttcccgagaaccagattttggcgcgcccgccggcccccaccatcactaccgtcagtgaaaacgttcctgctctcacagatcacgggacgctaccgctgcgcaacagcatctcaggagtccagcgagtgaccattactgacgccagacgccggacctgcccctacgtttacaaggccttgggcatagtctcgccgcgcgtcctctccagccgcactttttaaaacacatattcacccacgcttcaaagattatgtctatacttatctcacccagcaataacaccggctgggggctgcgcgcgcccagcaagatgtttggaggggcgagaaaacgttccgagcagcacccagtgcgcgtgcgcggccactaccgcgcgccctggggagcgcacaagcgcgggcgcgcagggcgcaccactgtggacgacgccattgactccgtagtggagcaggcgcgccactacacacccggcgcgccgtccgcccccgccgtgtccaccgtggacgaggcgatcgaaagcgtggtacagggcgcgcggcactatgccaaccttaaaaatcgccgccgtcgcgtggcccgccgccatcgccggagaccccgggccaccgccgccgcgcgccttgctaaggctctactcaggcgcgccaggcgaactggccgccgggccgccatgagggccgcacggcgggctgccgccagtgcggccgccgcggccccacgggcacgaaggcgcgcggccgctgccgccgccgccgccatttccagcttggcctcaacgcggcgcggtaacatatactgggtgcgcgactcgataaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgatgacgaggcggtggagtttgtccgccgcatggcacccaggcgccccgtgcagtggaagggtcggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtgaccctgcaacaggtgctgcctttgagcgcgcccagcgagcataagcgagggttgaagcgcgagggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcagcggccagcgccaccaccggcaccgcttcggtagaggtgcagacggacccctggctacccgccgccgctgtcgccgccgccgccgccccccgttctcgcgggcgcaagagaaattatccagtggccagcgcgctcatgccccagtacgcactgcatccatccatcgcgcccacccccggctaccgcgggtattcgtaccgcccgcgcagatcggccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcatttttttggaggaaaaataaaaaagtctagactctcacgctcgcttggtcctgtgactattttgtagaaaaaagatggaagacatcaactttgcgtcgctggccccgcgtcatggctcgcgcccgttcatgggagactggacagatatcggcaccagcagtatgagcggtggcgccttcagctggggcagtctgtggagcggccttaaaaattttggttccaccattaaaaactatggcaacaaagcgtggaacagcagcacgggccagatgctaagagacaagttgaaagagcagaacttccaggagaaggtggcgcagggcctggcctctggcatcagcggggtggtggacatagctaaccaggccgtgcagaaaaagataaacagtcatctggacccccgccctcaggtggaggaaacgcctccagccatggagacggtgtttcccgagggcaaaggcgaaaagcgcccgcggcccgacagggaagagaccctggtgtcacacaccgaggagccgccctcttacgaggaggcactcaaggccggcctgcccaccactcgccccgtagctcccatggccacaggtgtggtgggccataaacaacacacccccgcaacactagatctgcccccgccgtccgagccgccgcgtcagccaaagacggcgacggtgcccgctccctccacttccgccgccaacagagtgtccctgcgccgcactacgggcgcccctcggggaccgcgactgagcggcaactggcagagcacactgaacagcattgtgggcctgggagtgaaaagtgtgaagcgccgccgttgctactgaatgagcaagctagctaacgtgttatatgtgtgtatgcgtcctatgtcgccgccagaggagctgttgagccgcccgcgccgtctgcactccagcgaatttcaagatggcgaccccttcgatgatgccacagtggtcgtacatgcacatctcgggccaggacgcctcggagtacctgagccccgggctggtgcagttcgcccgcgccaccgacagctacttcagcctaagtaacaaatttaggaaccctacggtggcacccacccacgatgtgaccacggaccggtcgcagcgcctgacgctgcggtttatccccgtggatcgggaggacactgcctactcttacaaggcgcgcttcacgctagccgtgggcgacaaccgcgtgctggacatggcctccacctactttgatatccggggtgtgctggacaggggtcccacctttaagccctactcgggcactgcctacaactccctggctcctaaaggcgctcccaattcttgcgagtgggatgaaaaaactaatactgctgaagcagccattgaaaatgaagaagagctggcggatgagccagaagagcaagcagaagaggctataaaaaccaatgtgtttgcccaggcgccatattctggcaatgcaatttccaaagaaggaatacaagtaggcatagaaggcattggagagcaagtaaaagccgtatacgcagacaaaacctaccagccggaacctcaggttggagaaactcaatggaatgagactgaaataaatcatggagcaggaagggtgctgaagaagaccactcccatgaagccttgctatggttcttatgctaaacctactaatgaatatggaggccagggcatccttgtagaaaaaaatggcaaaatggaaagccaggtggaaacacagttttttgctcttgacggtgaaaatgataatagtccaaaagtggtgttgtatagcgaagatgtaaacttggatactcctgacacacacctatcatacaaacctagcgcccaagatgtaaactctaaagaaatgttgggccaacaggccatgcccaacaggccaaatcttattgcttttagggacaactttattggacttatgtactacaacagcactggcaacatgggagtgctggcaggacaggcctcccaactaaatgccgtggtagacttgcaagacagaaacacagagttgtcataccagctgatgcttgattccattggagacagatcaagatattttgccatgtggaaccaggcggttgatagttacgatccagatgttagaattattgaaaaccatggcacagaggatgaacttccaaactactgttttcctttgggaggaatatttaatactcagagttttaaaaaggtaaaacctggaacggataacggatgggaaacagatgatgacttttcagataaaaatgaaataagagttggcaacaactttgccatggagatcaatatccaggcaaacctgtggagaagcttcttgtattccaatgtggctctctacctgccagataagatgaagtactctccaaccaacatagacatttccaccaacactaacacctatgactacatgaacaaaagagtggcgcctccaggcctggtggactgctatgtcaatctgggggccaggtggtcccttgatgtaatggataacatgaacccctttaaccaccaccgcaatgcgggcctgcgataccgttccatgcttctgggtaacggccgctacgtgcccttccacatccaggtgccccaaaagttctttgccatcaaaagccttctactcttgcctggctcgtacacctacgaatggaatttcagaaaggatgtgaacatggtcctacagagctctctgggcaacgaccttagggtggatggggccagcatcaagtttgacagcatcaccctttatgctacctttttccccatggcccacaacaccgcttccacgcttgaggccatgctcagaaacgacaccaacgaccagtccttcaatgactacctctctggggccaacatgctctaccccatccccgccaacgctaccaacgtgcccatctccattccctctcgcaactgggccgccttcagaggctgggcatttacccgccttaagaccaaggagaccccctccctgggctcgggttttgacccctactttgtctactcgggatccatcccctacctggatggcaccttctacctcaaccacacttttaagaagatatccatcatgtatgactcctctgtcagctggccgggcaacgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccgttggcatcactcaccagcacaacaactcgggattcgtgggctacctggcacccaccatgcgcgagggacaggcctaccccgccaacttcccctaccccttgataggcaagaccgcggtcgacagcgtcacccagaaaaagttcctctgcgaccgcaccctctggcgcatccccttttctagcaacttcatgtccatgggcgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacttgctacctctttgacccttttggcttctccgatcagcgcctcaagcagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcgcatccggggggccacctctttctgccacttgcaagaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggttcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattatgcacgctggccagcaggctctcgtcgctgatcatgtcgctgtccagatcctccgcgttgctcagggcgaatggggtcatcttgcagacctgcctgcccaggaaaggcggcagcccgggcttgccgttgcagtcgcagcgcaggggcatcagcaggtgcccgcggcccgactgcgcctgcgggtacagcgcgcgcatgaaggcttcgatctgcctgaaagccacctgcgccttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtcccgtgcagacacttcaggtcgccctccgtctgggtgcagcggtgctcccacagcgcgcaaccggtgggctcccaattcttgtgggtcacccccgcgtaggcctgcaggtaggcctgcaagaagcgccccatcatggccacgaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagcgccgcctgctcttcttcgtcttcgctgtctaccactatctctggggaagggcttctccgctctgcggcggtgcgcttcttttttttcttgggagcagccgtgacggagtccgccacggcgacggaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcctctcgagctggtcttggtctcgactggccattgtatcctcctcctcctaggcagagagacataaggagtctatcatgcaagtcgagaaggaggagagcttaaccaccccctctgacaccgccgatgcgcccgccgtcgccgtcgcccccgctgccgccgacgcgcccgccacaccgagcgacacccccgcggacccccccgccgacgcacccctgttcgaggaagcggccgtggagcaggacccgggctttgtctcggcagaggaggatttgcgagaggaggagaataaggagaagaagccctcagtgccaaaagatgataaagagcaagacgagcacgacgcagatgcacaccagggtgaagtcgggcggggggacggagggcatggcggcgccgactacctagacgaagggaacgacgtgctcttgaagcacctgcatcgtcagtgcgccatcgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgccttcgtggtgcccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtgccaaagatctttgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctaaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgcggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgtctggaggagcgcaacctcaaagagctggagaagctcctgcagcgcgcgctcaaagacctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaggaccaatcccgcccgcccaaggcggagctgaccgcctgcgtcatcacccagggcgagatcctaggccaattgcaagccatccaaaaagcccgccaagattttttgctgaagaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcgattaccaccacgccccgcaataatcccaaccccagggagtggcccgcgtccctggtgtatcaggaaattcccggccccaccaccgtactacttccgcgtgattcccaggccgaagtccaaatgactaactcaggggcgcagctcgcgggcggctgtcgtcacagggtgcggccccctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctccggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgagaaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgattttatagaaccccagtgcaatatcacttataaatctgaatataacctctgcactatcctaattaaatgcgttactcaacacgatgaggtaactgttagatacaaagatcaatcaaaaagagacgcactttacagcagctggcaaccaggagatgaacaaaaatacaatgtgaccgtcttccagggcaaactctccaaaacttacaattacactttcccattcgaggagatgtgtgagtttgtcatgttcatgtcaaagcagtacaagatgtggcctccgactccccagggctgtgtggaaaatccaggctctttctgcatgatctctctctgtgtaactgtgctggcactaatactcacgcttttgtatatcagatttaaatcaaggcaaagcttcatcgatgaaaagaaaatgccttaatcgcttttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatttaaccttgattgatgttcaattgctggatgcgggctactattatgggcagctgggtacaatcgttaattactggagaccccacaaagattacatgcttcacgtagtaaagggtccccttagcagcccgaccactaccaccacctctaccacacccactaccaccactactcccatcaccagcactgccacccagcctcctcatagcagaacaaccacttttatcaattccaagtcccactccccccacattgccggcgggccctccgcctcaaactccgagaccaccgagatctgcttctgcaaatgctctgacgccattgcccaggatttggaagaccacgaggaagatgagcatgacttcgcagatgcatgccaggcatcaggggcagaagcactgccggtggccctcaaacagtatgcagactcccataccacccccgatcttccaccgccttcccagaagccaagtttcctgggggaaaatgaaacactgcctctctccatacttgctttgacatctgttgctattctgactgctctgctggtgctcctatgctctatatgctacctgatctgctgcaggaagaaaaaatctcacggccatgctcaccagccgcttatgcacttcccttaccctccagagttgggcgaccacaaactttaagtctgcagtagctatctgcccatcccttgtcagtcgacagcgatgagccccactaatctaacggcctctggacttacaacattgtctcttaatgagaccaccgctcctcaagacctgtacgatggtgtctccgcgctggttaaccagtgggatcacctgggcatatggtggctcctcataggagcagtgaccctgtgcctaatcctggtctggataatctgctgcatcaaaagcagaagacccaggcggcggcccatctacaggcccttcgtcatcacacctgaagatgatgatggcaccacgtccaggctgcagagcctaaagcagctactcttctcttttacagcatggtaaattgaacatgcctcgcattttcatctacttgtttcttcttccactctttttgggctcttctacattggcagctgtgtcccacatcgaggtagactgcatctcgcccttctcagtctacttactcttcggctttgtcatttgcaactttgtctgcagcgttatcactgtagtgatctgcttcatacagtgcatcgactacgtctgcgtacgggtggcctattttagacaccacccccagtatcgcaacagggacatagcggctctcctaagacttgtttaaatcatgcccaaattaactgtgattgctcttctgattatctgctgcgtcctagccgcgattgggactcagcctactaccaccaccaccagcgctcccagaaagagacatgtttcctgcagcttcaaacgtccctggaatataccccaatgctttactgatgaacctgaaatctctttggcttggtacttcagcgtcaccgcccttctcatcttctgcagtacggttattgcccttgccatttacccttcccttgacctgggctggaatgctgtcaactctatggaatatcccaccttcccagaaccagacctgccagacctggttgttctaaacgcgtttcctcctcctcccgttcaaaatcagtttcgccctccgtccccgacgcccactgaggtcagctactttaatctaacaggcggagatgactgaaaacctagacctagaaatggacggcctctgcagcgaacaacgcatactagagaggcgccggcaaaaagcagagctcgagcgtcttaaacaagagctccaagacgcggtggccatacaccagtgcaaaaaaggtgtcttctgtctagtgaaacaggccacgctcacctatgaaaaaacaggtgacacccaccgcctaggatacaagctgcccacacaacgccagaagttcgcccttatgataggcgaacaacccatcaccgtcacccagcactctgtggagacagaaggctgcatacacgctccctgcaggggcgctgactgtctctacaccttgatcaaaaccctctgcggccttagagacctcatccctttcaattgatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtcccttttcccacccctccctttgtgtcccccgcaggaatgcaagaaaacccccctggagtgctatccctacgccttgcagaacccttgaccacctccaatggagcgctgaccctaaaaatggggggtggtttgaccctggacgaagaaggaaagcttacttcccaaaatattaccagtgttgatcctcctcttaaaaaaacaaaaaacaatatcagtctgcagactgcctccccccttgccgtcagctcgggagccctcacacttttcgctactcctcccctggcagttaatgacaataacctaactgtgcagtctcaggctccccttacactggaaaactcaaaactaagtctggccaccaaaggccccctaaccgtttctgaaggaaaacttgccctagaaacagaggctcccttgcatgcaagcgacagcagtagcctaggccttagtgtaacggccccactgagcattagcagcgacagcctaggactagacttgcaagcgcccattatttctgaaaatggaaaactgggcctaagagtaacaggtcccctaactgtggccagcagtattgatgctttgacagtagccacaggcagcggtattggacttgatagcaacacgcgcctacaggcaaaattggtcgcgcccctaggctttgacaccaatggcaacattaagctcagcacttcgggcggcatgagactgaacaatggcacacttatactagatgtaaactacccatttgaggctcaaggtcaacttagtctaagagtgggttcgggtccactgtatgtagactccaacacacataacctaaccgctagatgccttagagggctatacataacgtcatctaataaccaaaccggcctggaggccaacataaaacttacaaaaggacttgtgtttgatggaaatgccatagcagttaatgttagcaaagggctagaatacagtaccactgaaacagcgcagggtgtaaatcccatacagactaaaataggtttgggcatggaatatgataccaatggagccataaagccaagactaggctctggtttgagctttgataattcaggagctattgtagtgggaaacaaaaatgatgacactcttactctgtggactacaccagacccatctcccaactgtcagattaactcggaaaaagatgctaaactaaccttggtactaaccaagtgcggtagtcaaattgtaggcacagtatctgcctttgctcttaaaggcagccttgccccaattaatggcacagtgagctcagttagtatattcctaagatttaatgaaaatggggtactgatgagcaactcatcgttggaaagccaatactggaattacaggaatggaaattcaactaatgccacaccatatacaaatgcactaggttttatgcctaacctggcagcttatcccaaaggccaggcaacgactgcaaaaagcagcatcattagccaggtttacatgaatggtgacacttccaaacctatgatatttacaataacttttaatgggcttgaaacagaggaaactcaggtcagtacatattccatgacattttcatggaggtggacaaatggagactacgtggggcactattttaaaacaaactcctttactttctcctacattgcccaagaataaagaaagcacagagatgcttgtttttgatttcaaaattgtgtgcttttatttatttcaagcttacagtatttccagtagtcattcgaatagagcttaattaaactgcatgagaacccttccacatagcttaaattagcaccagtgcaaatggagaaaaatcaacatacctttttatccagatatcagagaactctagtggtcagttttcccccaccctcccagctcacagaatacacagtcctttccccccggctggctttaaacaacactatctcattggtaacagacatattcttaggtgtaataatccacacggtctcttggcgggccaaacgctggtcggtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgcagcaacaaggcgcgcagcaactcctgccgccgcctctccgtacggcaggaatgcaacggcgtggtggtctcctccgcgataatccgcaccgctcgcagcatcagcatcctcgtcctccgggcacagcagcgcatcctgatctcactgagatcggcgcagtaagtgcagcacaaaaccaagatgttatttaagatcccacagtgcaaagcgctgtacccaaagctcatggcgggaaggacagcccccacgtgaccatcataccagatcctcaggtaaatcaaatgacgacctctcataaacacgctggacatgtacatcacctccttgggcatgtgctgattcaccacctctcgataccacaagcatcgctgattaattaaagacccctcgagcaccatcctgaaccaggaagccagcacctgaccccccgccaggcactgcagggaccccggtgaatcgcagtggcagtgaagactccagcgctcgtagccgtgaaccatagagctggtcattatatccaaattggcacaacacagacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgttcggtgtagtagttgtaatacagccactccctgagaccgtcaaggcgctccctggcgtccggatctatgacaacaccgtcctgcagcgccgccctgatgacatccaccaccgtagagtatgccaagcccagccaggaaatgcattcactttgacagcgagagataggaggagcggggagagatggaagaaccatgatagtaaagagaacttttattccaatcgatcttctaagatatcaaagtggagatctataagatgacactggtctcctccgctgagtcgatcaaaaataacagctaaaccacaaacaacacgattggtcaaatgctccacaagggcctgcagcataaaattgcctcggaactccaccgcaagcataacatcaaagccaccgcctctatcgtgatcaagaataaaaaccccacagctatccaccagacccatatagttttcatctctccatcgtgaaaaaagatttacaagctcctcctttaaatcacctccaaccaattgaaaaagttgaaccagaccgccctccaccttcattttcagcaagcgtatcatgattgcaaaaattcaggctcctcagacacctgtataagattgagaagcggaacgttaacatcgatgtttcgctcgcgtaaatcacgcctcagtgcaagcataatataatcccacaggtcggagcggatcagcgaggacacctccccgccaggaaccaactcaacggagcctatgctgattataatacgcatattcggagctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacgaccacagaaaaatgcacaatttttctctcaaacatgactgcgagccctgcaaaaaataaaaaagaaacattacacaagagtagcctgtcttacgatgggatagactactctaaccaacataagacgggccacaacatcgcccgcgtggccataaaaaaaattgtccgtgtgattaaaaagaagcacagatagctggccagtcatatccggagtcatcacgtgtgaacccgtgtagacccccgggttggacacatcggccaaagaaagaaagcggccaatgtacccaggaggaattataacactaagacgaagatacaacagaataaccccatgagggggaataacaaagttagtaggtgaataaaaacgataaacacccgaaactccctcctgcgtaggcaaaatagcaccctccccttccaaaacaacatatagcgcttccacagcagccatgacaaaagactcaaaacactcaaaagactcagtcttaccaggaaaataaaagcactctcacagcaccagcactaatcagagtgtgaaaagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccgctttctcacgatacgtcacttccgcaagaaaagcaaaactacatttcccacatgtgtaaaaacgaaaccccgccccttctaaccgcccacaacttacatcatcaaaacgtaaagtcctacgtcacccgccccgcctctccccgcccacctcattatcatattggccacaatccaaaataaggtatattat

SEQ ID NO: 24 - DNA, 37058 bp, Gorilla beringei graueri
ataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcaccgtcatttgacgcggagggtatttaaacccgctgcgctcctcaagaggccactcttgagtgccagcgagaagagttttctcctctgctccgcttcggtgatcgaaaaatgagacacatagcctgcactccgggtcttttgtccggtcgggcggcggccgagcttttggacgctttgatcaatgatgtcctgagcgatgattttccgtctactacccactttagcccacctactcttcacgaactgtacgatctggatgtactggtggatgtgaacgatcccaacgaggaggcggtttctgcgttttttcccgagtctgcgctgttggccgctcaggagggatttgacctacacactccgccgcctattttagagtctccgctgccggagcccagtggtataccttatatgcctgaactgcttcccgaagtggtagacctgacctgccacgagcctggctttccgcccagcgacgatgatggtgagccttttgttttagactttgctgagatacctgggcacggttgcaggtcttgtgcatatcatcagagggttaccggagaccccgaggttaagtgttcgctgtgctatatgaggatgacctcttcctttatctacagtaagtttttgtctaggtgggcttttgggtaggtgggttttgtgtcagaacaggtgtaaacgttgcttgtgttttttgtacctgtaggtccggtgtccgagccagacccggagcccgaccgcgatcccgagccggatcccgagcctcctcgcaggacaaggaaactaccttccattctgtgcaagtctcagacacctgtaaggaccagcgaggcagacagcaccgactctggcacttctacctctccccctgaaattcacccagtggttcctctgggtatacataaacctgttgctgttagagtttgcgggcgacgccctgcagtacagtgcattgaggacttgcttcacgatcccgaggaacctttggacttgagccttaaacgccctaggcaataaaccccacctaagtaataaaccccacctaagtaataaaccctgccgcccttggttattgagatgacgcccaatgtttgcttttgaatgacttcatgtgtgtaataaaagtgagtgtgatcataggtctcttgtttgtctgggcggggcttaagggtatataagtttctcggggctaaacttggttacacttgaccccaatggaggcgtgggggtgcttggaggagtttgcggacgtgcgccgtttgctggacgagagctctaaccatacctatactatttggaggtatctgtggggctctactcaggccaagttggtctccagaattaagcaggattacaagtgcgattttgaagagctttttagttcctgcggtgagcttttgcaatccttgaatctgggccatcaggctattttccaggaaaaggttctctcgactttggatttttccactcccgggcgcaccgccgcttgtgtggcttttgtgtcttttgtgcaagataaatggagcgaggagacccacctgagtcacggctacgtactggatttcatggcgatggctctttggagggctcacaacaaatggaagattcagaaggaactgtacggttccgccctacgtcgtccacttttgtcgcgacaggggctgaggtttcccgaccatcggcagcatcagaatctggaagacgagtcggaggagcgagcggaggagaagatcagcttgagagccggcctggaccctcctcaggaggaatgaatctcccgcaggtggttgacctgtttccagaactgagacgggtcctgactatcagggaggatggtcagtttgtgaagaagtttaagagggatcggggtgagggagatgatgaggcggctagcaatttagcttttagtctgatgactcgccaccgaccggaatgtattacctatcagcagattaaggagagttgtgccaacgagctggatcttttgggtcagaagtatagcatagaacagcttaccacttactggcttcagcctggggatgattgggaagaggcgatcagggtgtatgcaaaggtggccctgcggcccgattgcaagtataagattactaagttggttaatattagaaactgctgctatatttctgggaacggggccgaagtggagatagatactcaggacagggtggcttttaggtgttgcatgataaacatgtggcccgggatactggggatggatggggtggtgttcatgaatgtgaggtttacgggccccaactttaatggcacggtgttcatgggcaacaccaacttgctcctgcatggtgcgagtttctatgggtttaataacacctgtatagaggcctggaccgatgtaaaggttcgaggttgttccttttatagctgttggaaggcggtggtgtgtcgccctaaaagcaggggttctgtgaaaaaatgcttgtttgaaaggtgcaccttaggcatcctctctgagggcaactccagggtgcgccataatgtggcttcgaactgcggttgcttcatgcaagtgaagggggtgagcgttatcaagcataactcggtgtgtggaaactgcgaggatcgcgcctcccagatgctgacctgctttgatggtaactgtcacctgttgaagaccattcatataagcagccaccccagaaaggcctggcccgtgtttgagcataacatcctgacccgctgctccttgcatctgggggtcaggaggggtatgttcctgccttaccagtgtaactttagccacactaaaatcctgctggaacccgagtgtatgaccaaggtcagcctaaatggcgtgtttgatgcgactctgagaatctggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgcaccagggccgagtttgggtctagcgatgaggataccgattgaggtgggtaaggtgggcgtggctagaagggtggggcgtgtataaattgggggtctaagggtctctctgttttgtcttgcaacagccgccgccatgagcgacaccggcaacagctttgatggaagcatctttagcccctatctgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcggcgcggcctctcgcgcgtctgctcgggatgagaaactgaccgctctgctgcttaaactggaagacttgacccgggagctggctcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataagacatctttacaaatcgggggcggagggtcccggactggggtatgatggtaccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagcctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcgccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtcctgaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaaggaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacgggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcctcctggagatctcctcgtccggcgcgctccacggtggccgccaggtcgttggagatgcgacccatgagctgcgagaaggcgttgagcccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacgccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcataaggcggtggtatccgtagatgtacctggacatccaggtgatgccggcggcggtggtggtggcgcgcgcgtagtcgcggacccggttccagatgtttcgcaggggcaagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgagggccgtggcagccccgtcctcaggaccccgccagccgacttctccagttacgggagcgagccccttttgtttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtgaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggacgatgaccaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgagtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggatgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttgaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggaaacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacgcaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcattaaccgcctgatggactacttgcatcgggcggcggccgtgaaccccgagtacttcactaatgccattctgaatccccactggatgccccctccgggtttctacaacggggacttcgaggtgcccgaggttaacgacgggttcctctgggatgacatggatgacagtgtgttctcacccaacccgctgcgcgccgcgtctctgcgattgaaggagggttctgacagggaaggaccgaggagtctggcctcctccctggctctgggagcggtgggcgcggcggcgcggggcagtagccccttccccagcctggcagactctctgaacagcgggcgggtgagcaggccccgcttgctaggcgaggaggagtatctgaacaactccctgctgcagcccgcgagggacaaaaacgctcagcggcagcagtttcccaacaatgggatagagagcctggtggacaagatgtccagatggaagacgtatgcgcaggagtacaaggagtgggaggaccgccagccgcggcccctgccgccccctaggcagcgctggcagcggcgcgcgtccaaccgccgctggaggcaggggcccgaggacgatgatgactctgcagatgacagcagcgtgctggacctgggcgggagcgggaaccccttttcgcacctgcgcccccgcctgggcaagatgttttaaaagagaaaaaataaaaactcaccaaggccatggcgacgagcgttggttttttgttcccttccttagtatgcgacgcgcggcgatgttcgaggaggggcctcccccctcttacgagagcgcgatgggattttctcctgcgacgcccctacagcctccctacgtgcctcctcggtacctgcaacctaccgggggaagaaatagcatctgttactctgagctgcagcccctgtatgacaccaccaaagtgtacctggtggacaacaagtctgcggacgtggcctccctgaactaccagaacgaccacagcgattttttgaccaccgtgatccaaaacaatgacttcaccccaaacgaggccagcacccagaccataaacctggacaacaggtcgcactggggcggtgatctgaagaccatcttgcacaccaacatgcccaacgtgaatgagtttatgtttactaactcttttaaggcgcgggtaatggtggcgcgcgacgataagggagtgcctaaatacgagtgggtggactttacactgcccgagggcaactactccgagatcatgactcttgacctgatgaacaacgcgatcgtggagcactacttgaaagtaggcaggcagaacggggtaaaagaaagcgatattggagttaagtttgacaccaggaactttcgcctgggatgggaccccgagacggggttggttatgcccggggtttacactaatgaagcttttcaccccgatatagtgctcttgcccggatgcggggtggacttcacccaaagccggctgagcaacctgctgggcattcgaaagcgccagccattccaggaggggtttcaaatcacttatgagcatttggaagggggcaacattccggcgcttctggatttggtcgcctacgaggagagtttgaaatccgaggaaagcggggataacactgacaagggcggcgaggagcaagccggcgatggcgacactgcttcggtagaaaacgaaagtgcgtccgtggtggaggcggcggcggtagcgaccgcagagccggagaccgtagaggaggatatgaatgatagcgcaatcagaggagactcgtttattccccggggcgaagaaaagaaggcggaggctgcggcagcagtcgaagcagagcccaaagtcgagtcggagatcatggaggaggatttgaatgataacgcgatcagaggtgatacgtttgtgccgcggggcgaagaaaaaaaagcggaggcggaggccgcggctgaggaggcggccgaggctgtggcagccaccgcggcggtgactgaaacaactgaggagcaggttcaggccgagcaggttcaaaagaagcccgtgattaaagccctaacacaagatagcaaggagcgcagttacaacttgattcccggtagtactgacaccgagtaccgcagctggtacctggcatacaactacggcgacccggtcaaaggggtgcgctcgtggactctgctttgcacgccggacgtcacctgcggctccgagcagatgtactggtcgttgccaaacatgatgcaagacccggtgaccttccgctccacgcggcaggttaacaacttcccggtggtgggcgccgaactgctgcccgtgcactccaagagcttttacaacgagcaggccgtgtactcccagctgatccgccaggccacctctctgacccacgtgttcaatcgctttcccgagaaccagattttggcgcgcccgccggcccccaccatcactaccgtcagtgaaaacgttcctgctctcacagatcacgggacgctaccgctgcgcaacagcatctcaggagtccagcgagtgaccattactgacgccagacgccggacctgcccctacgtttacaaggccttgggcatagtctcgccgcgcgtcctctccagccgcactttttaaaacacatattcacccacgcttcaaagattatgtctatacttatctcacccagcaataacaccggctgggggctgcgcgcgcccagcaagatgtttggaggggcgagaaaacgttccgagcagcacccagtgcgcgtgcgcggccactaccgcgcgccctggggagcgcacaagcgcgggcgcgcagggcgcaccactgtggacgacgccattgactccgtagtggagcaggcgcgccactacacacccggcgcgccgtccgcccccgccgtgtccaccgtggacgaggcgatcgaaagcgtggtacagggcgcgcggcactatgccaaccttaaaaatcgccgccgtcgcgtggcccgccgccatcgccggagaccccgggccaccgccgccgcgcgccttgctaaggctctactcaggcgcgccaggcgaactggccgccgggccgccatgagggccgcacggcgggctgccgccagtgcggccgccgcggccccacgggcacgaaggcgcgcggccgctgccgccgccgccgccatttccagcttggcctcaacgcggcgcggtaacatatactgggtgcgcgactcgataaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgatgacgaggcggtggagtttgtccgccgcatggcacccaggcgccccgtgcagtggaagggtcggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtgaccctgcaacaggtgctgcctttgagcgcgcccagcgagcataagcgagggttgaagcgcgagggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcagcggccagcgccaccaccggcaccgcttcggtagaggtgcagacggacccctggctacccgccgccgctgtcgccgccgccgccgccccccgttctcgcgggcgcaagagaaattatccagtggccagcgcgctcatgccccagtacgcactgcatccatccatcgcgcccacccccggctaccgcgggtattcgtaccgcccgcgcagatcggccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcatttttttggaggaaaaaataaaaaagtctagactctcacgctcgcttggtcctgtgactattttgtagaaaaaagatggaagacatcaactttgcgtcgctggccccgcgtcatggctcgcgcccgttcatgggagactggacagatatcggcaccagcagtatgagcggtggcgccttcagctggggcagtctgtggagcggccttaaaaattttggttccaccattaaaaactatggcaacaaagcgtggaacagcagcacgggccagatgctaagagacaagttgaaagagcagaacttccaggagaaggtggcgcagggcctggcctctggcatcagcggggtggtggacatagctaaccaggccgtgcagaaaaagataaacagtcatctggacccccgccctcaggtggaggaaacgcctccagccatggagacggtgtttcccgagggcaaaggcgaaaagcgcccgcggcccgacagggaagagaccctggtgtcacacaccgaggagccgccctcttacgaggaggcactcaaggccggcctgcccaccactcgccccgtagctcccatggccacaggtgtggtgggccataaacaacacacccccgcaacactagatctgcccccgccgtccgagccgccgcgtcagccaaagacggcgacggtgcccgctccctccacttccgccgccaacagagtgtccctgcgccgcactacgggcgcccctcggggaccgcgactgagcggcaactggcagagcacactgaacagcattgtgggcctgggagtgaaaagtgtgaagcgccgccgttgctactgaatgagcaagctagctaacgtgttatatgtgtgtatgcgtcctatgtcgccgccagaggagctgttgagccgcccgcgccgtctgcactccagcgaatttcaagatggcgaccccttcgatgatgccacagtggtcgtacatgcacatctcgggccaggacgcctcggagtacctgagccccgggctggtgcagttcgcccgcgccaccgacagctacttcagcctaagtaacaaatttaggaaccctacggtggcacccacccacgatgtgaccacggaccggtcgcagcgcctgacgctgcggtttatccccgtggatcgggaggacactgcctactcttacaaggcgcgcttcacgctagccgtgggcgacaaccgcgtgctggacatggcctccacctactttgatatccggggtgtgctggacaggggtcccacctttaagccctactcgggcactgcctacaactccctggctcctaaaggcgctcccaattcttgcgagtgggatgaaaaaactaatactgctgaagcagccattgaaaatgaagaagagctggcggatgagccagaagagcaagcagaagaggctataaaaaccaatgtgtttgcccaggcgccatattctggcaatgcaatttccaaagaaggaatacaagtaggcatagaaggcattggagagcaagtaaaagccgtatacgcagacaaaacctaccagccggaacctcaggttggagaaactcaatggaatgagactgaaataaatcatggagcaggaagggtgctgaagaagaccactcccatgaagccttgctatggttcttatgctaaacctactaatgaatatggaggccagggcatccttgtagaaaaaaatggcaaaatggaaagccaggtggaaacacagttttttgctcttgacggtgaaaatgataatagtccaaaagtggtgttgtatagcgaagatgtaaacttggatactcctgacacacacctatcatacaaacctagcgcccaagatgtaaactctaaagaaatgttgggccaacaggccatgcccaacaggccaaatcttattgcttttagggacaactttattggacttatgtactacaacagcactggcaacatgggagtgctggcaggacaggcctcccaactaaatgccgtggtagacttgcaagacagaaacacagagttgtcataccagctgatgcttgattccattggagacagatcaagatattttgccatgtggaaccaggcggttgatagttacgatccagatgttagaattattgaaaaccatggcacagaggatgaacttccaaactactgttttcctttgggaggaatatttaatactcagagttttaaaaaggtaaaacctggaacggataacggatgggaaacagatgatgacttttcagataaaaatgaaataagagttggcaacaactttgccatggagatcaatatccaggcaaacctgtggagaagcttcttgtattccaatgtggctctctacctgccagataagatgaagtactctccaaccaacatagacatttccaccaacactaacacctatgactacatgaacaaaagagtggcgcctccaggcctggtggactgctatgtcaatctgggggccaggtggtcccttgatgtaatggataacatgaacccctttaaccaccaccgcaatgcgggcctgcgataccgttccatgcttctgggtaacggccgctacgtgcccttccacatccaggtgccccaaaagttctttgccatcaaaagccttctactcttgcctggctcgtacacctacgaatggaatttcagaaaggatgtgaacatggtcctacagagctctctgggcaacgaccttagggtggatggggccagcatcaagtttgacagcatcaccctttatgctacctttttccccatggcccacaacaccgcttccacgcttgaggccatgctcagaaacgacaccaacgaccagtccttcaatgactacctctctggggccaacatgctctaccccatccccgccaacgctaccaacgtgcccatctccattccctctcgcaactgggccgccttcagaggctgggcatttacccgccttaagaccaaggagaccccctccctgggctcgggttttgacccctactttgtctactcgggatccatcccctacctggatggcaccttctacctcaaccacacttttaagaagatatccatcatgtatgactcctctgtcagctggccgggcaacgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccgttggcatcactcaccagcacaacaactcgggattcgtgggctacctggcacccaccatgcgcgagggacaggcctaccccgccaacttcccctaccccttgataggcaagaccgcggtcgacagcgtcacccagaaaaagttcctctgcgaccgcaccctctggcgcatccccttttctagcaacttcatgtccatgggcgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacttgctacctctttgacccttttggcttctccgatcagcgcctcaagcagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcgcatccggggggccacctctttctgccacttgcaagaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggttcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattatgcacgctggccagcaggctctcgtcgctgatcatgtcgctgtccagatcctccgcgttgctcagggcgaatggggtcatcttgcagacctgcctgcccaggaaaggcggcagcccgggcttgccgttgcagtcgcagcgcaggggcatcagcaggtgcccgcggcccgactgcgcctgcgggtacagcgcgcgcatgaaggcttcgatctgcctgaaagccacctgcgccttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtcccgtgcagacacttcaggtcgccctccgtctgggtgcagcggtgctcccacagcgcgcaaccggtgggctcccaattcttgtgggtcacccccgcgtaggcctgcaggtaggcctgcaagaagcgccccatcatggccacgaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagcgccgcctgctcttcttcgtcttcgctgtctaccactatctctggggaagggcttctccgctctgcggcggtgcgcttcttttttttcttgggagcagccgtgacggagtccgccacggcgacggaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcctctcgagctggtcttggtctcgactggccattgtatcctcctcctcctaggcagagagacataaggagtctatcatgcaagtcgagaaggaggagagcttaaccaccccctctgacaccgccgatgcgcccgccgtcgccgtcgcccccgctgccgccgacgcgcccgccacaccgagcgacacccccgcggacccccccgccgacgcacccctgttcgaggaagcggccgtggagcaggacccgggctttgtctcggcagaggaggatttgcgagaggaggagaataaggagaagaagccctcagtgccaaaagatgataaagagcaagacgagcacgacgcagatgcacaccagggtgaagtcgggcggggggacggagggcatggcggcgccgactacctagacgaagggaacgacgtgctcttgaagcacctgcatcgtcagtgcgccatcgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgccttcgtggtgcccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtgccaaagatctttgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctaaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgcggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgtctggaggagcgcaacctcaaagagctggagaagctcctgcagcgcgcgctcaaagacctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaggaccaatcccgcccgcccaaggcggagctgaccgcctgcgtcatcacccagggcgagatcctaggccaattgcaagccatccaaaaagcccgccaagattttttgctgaagaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcgattaccaccacgccccgcaataatcccaaccccagggagtggcccgcgtccctggtgtatcaggaaattcccggccccaccaccgtactacttccgcgtgattcccaggccgaagtccaaatgactaactcaggggcgcagctcgcgggcggctgtcgtcacagggtgcggccccctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctccggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgagaaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgattttatagaaccccagtgcaatatcacttataaatctgaatataacctctgcactatcctaattaaatgcgttactcaacacgatgaggtaactgttagatacaaagatcaatcaaaaagagacgcactttacagcagctggcaaccaggagatgaacaaaaatacaatgtgaccgtcttccagggcaaactctccaaaacttacaattacactttcccattcgaggagatgtgtgagtttgtcatgttcatgtcaaagcagtacaagatgtggcctccgactccccagggctgtgtggaaaatccaggctctttctgcatgatctctctctgtgtaactgtgctggcactaatactcacgcttttgtatatcagatttaaatcaaggcaaagcttcatcgatgaaaagaaaatgccttaatcgcttttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatttaaccttgattgatgttcaattgctggatgcgggctactattatgggcagctgggtacaatcgttaattactggagaccccacaaagattacatgcttcacgtagtaaagggtccccttagcagcccgaccactaccaccacctctaccacacccactaccaccactactcccatcaccagcactgccacccagcctcctcatagcagaacaaccacttttatcaattccaagtcccactccccccacattgccggcgggccctccgcctcaaactccgagaccaccgagatctgcttctgcaaatgctctgacgccattgcccaggatttggaagaccacgaggaagatgagcatgacttcgcagatgcatgccaggcatcaggggcagaagcactgccggtggccctcaaacagtatgcagactcccataccacccccgatcttccaccgccttcccagaagccaagtttcctgggggaaaatgaaacactgcctctctccatacttgctttgacatctgttgctattctgactgctctgctggtgctcctatgctctatatgctacctgatctgctgcaggaagaaaaaatctcacggccatgctcaccagccgcttatgcacttcccttaccctccagagttgggcgaccacaaactttaagtctgcagtagctatctgcccatcccttgtcagtcgacagcgatgagccccactaatctaacggcctctggacttacaacattgtctcttaatgagaccaccgctcctcaagacctgtacgatggtgtctccgcgctggttaaccagtgggatcacctgggcatatggtggctcctcataggagcagtgaccctgtgcctaatcctggtctggataatctgctgcatcaaaagcagaagacccaggcggcggcccatctacaggcccttcgtcatcacacctgaagatgatgatggcaccacgtccaggctgcagagcctaaagcagctactcttctcttttacagcatggtaaattgaacatgcctcgcattttcatctacttgtttcttcttccactctttttgggctcttctacattggcagctgtgtcccacatcgaggtagactgcatctcgcccttctcagtctacttactcttcggctttgtcatttgcaactttgtctgcagcgttatcactgtagtgatctgcttcatacagtgcatcgactacgtctgcgtacgggtggcctattttagacaccacccccagtatcgcaacagggacatagcggctctcctaagacttgtttaaatcatgcccaaattaactgtgattgctcttctgattatctgctgcgtcctagccgcgattgggactcagcctactaccaccaccaccagcgctcccagaaagagacatgtttcctgcagcttcaaacgtccctggaatataccccaatgctttactgatgaacctgaaatctctttggcttggtacttcagcgtcaccgcccttctcatcttctgcagtacggttattgcccttgccatttacccttcccttgacctgggctggaatgctgtcaactctatggaatatcccaccttcccagaaccagacctgccagacctggttgttctaaacgcgtttcctcctcctcccgttcaaaatcagtttcgccctccgtccccgacgcccactgaggtcagctactttaatctaacaggcggagatgactgaaaacctagacctagaaatggacggcctctgcagcgaacaacgcatactagagaggcgccggcaaaaagcagagctcgagcgtcttaaacaagagctccaagacgcggtggccatacaccagtgcaaaaaaggtgtcttctgtctagtgaaacaggccacgctcacctatgaaaaaacaggtgacacccaccgcctaggatacaagctgcccacacaacgccagaagttcgcccttatgataggcgaacaacccatcaccgtcacccagcactctgtggagacagaaggctgcatacacgctccctgcaggggcgctgactgtctctacaccttgatcaaaaccctctgcggccttagagacctcatccctttcaattgatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtcccttttcccacccctccctttgtgtcccccgcaggaatgcaagaaaacccccctggagtgctatccctacgccttgcagaacccttgaccacctccaatggagcgctgaccctaaaaatggggggtggtttgaccctggacgaagaaggaaagcttacttcccaaaatattaccagtgttgatcctcctcttaaaaaaacaaaaaacaatatcagtctgcagactgcctccccccttgccgtcagctcgggagccctcacacttttcgctactcctcccctggcagttaatgacaataacctaactgtgcagtctcaggctccccttacactggaaaactcaaaactaagtctggccaccaaaggccccctaaccgtttctgaaggaaaacttgccctagaaacagaggctcccttgcatgcaagcgacagcagtagcctaggccttagtgtaacggccccactgagcattagcagcgacagcctaggactagacttgcaagcgcccattatttctgaaaatggaaaactgggcctaagagtaacaggtcccctaactgtggccagcagtattgatgctttgacagtagccacaggcagcggtattggacttgatagcaacacgcgcctacaggcaaaattggtcgcgcccctaggctttgacaccaatggcaacattaagctcagcacttcgggcggcatgagactgaacaatggcacacttatactagatgtaaactacccatttgaggctcaaggtcaacttagtctaagagtgggttcgggtccactgtatgtagactccaacacacataacctaaccgctagatgccttagagggctatacataacgtcatctaataaccaaaccggcctggaggccaacataaaacttacaaaaggacttgtgtttgatggaaatgccatagcagttaatgttagcaaagggctagaatacagtaccactgaaacagcgcagggtgtaaatcccatacagactaaaataggtttgggcatggaatatgataccaatggagccataaagccaagactaggctctggtttgagctttgataattcaggagctattgtagtgggaaacaaaaatgatgacactcttactctgtggactacaccagacccatctcccaactgtcagattaactcggaaaaagatgctaaactaaccttggtactaaccaagtgcggtagtcaaattgtaggcacagtatctgcctttgctcttaaaggcagccttgccccaattaatggcacagtgagctcagttagtatattcctaagatttaatgaaaatggggtactgatgagcaactcatcgttggaaagccaatactggaattacaggaatggaaattcaactaatgccacaccatatacaaatgcactaggttttatgcctaacctggcagcttatcccaaaggccaggcaacgactgcaaaaagcagcatcattagccaggtttacatgaatggtgacacttccaaacctatgatatttacaataacttttaatgggcttgaaacagaggaaactcaggtcagtacatattccatgacattttcatggaggtggacaaatggagactacgtggggcactattttaaaacaaactcctttactttctcctacattgcccaagaataaagaaagcacagagatgcttgtttttgatttcaaaattgtgtgcttttatttatttcaagcttacagtatttccagtagtcattcgaatagagcttaattaaactgcatgagaacccttccacatagcttaaattagcaccagtgcaaatggagaaaaatcaacatacctttttatccagatatcagagaactctagtggtcagttttcccccaccctcccagctcacagaatacacagtcctttccccccggctggctttaaacaacactatctcattggtaacagacatattcttaggtgtaataatccacacggtctcttggcgggccaaacgctggtcggtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgcagcaacaaggcgcgcagcaactcctgccgccgcctctccgtacggcaggaatgcaacggcgtggtggtctcctccgcgataatccgcaccgctcgcagcatcagcatcctcgtcctccgggcacagcagcgcatcctgatctcactgagatcggcgcagtaagtgcagcacaaaaccaagatgttatttaagatcccacagtgcaaagcgctgtacccaaagctcatggcgggaaggacagcccccacgtgaccatcataccagatcctcaggtaaatcaaatgacgacctctcataaacacgctggacatgtacatcacctccttgggcatgtgctgattcaccacctctcgataccacaagcatcgctgattaattaaagacccctcgagcaccatcctgaaccaggaagccagcacctgaccccccgccaggcactgcagggaccccggtgaatcgcagtggcagtgaagactccagcgctcgtagccgtgaaccatagagctggtcattatatccaaattggcacaacacagacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgttcggtgtagtagttgtaatacagccactccctgagaccgtcaaggcgctccctggcgtccggatctatgacaacaccgtcctgcagcgccgccctgatgacatccaccaccgtagagtatgccaagcccagccaggaaatgcattcactttgacagcgagagataggaggagcggggagagatggaagaaccatgatagtaaagagaacttttattccaatcgatcttctaagatatcaaagtggagatctataagatgacactggtctcctccgctgagtcgatcaaaaataacagctaaaccacaaacaacacgattggtcaaatgctccacaagggcctgcagcataaaattgcctcggaactccaccgcaagcataacatcaaagccaccgcctctatcgtgatcaagaataaaaaccccacagctatccaccagacccatatagttttcatctctccatcgtgaaaaaagatttacaagctcctcctttaaatcacctccaaccaattgaaaaagttgaaccagaccgccctccaccttcattttcagcaagcgtatcatgattgcaaaaattcaggctcctcagacacctgtataagattgagaagcggaacgttaacatcgatgtttcgctcgcgtaaatcacgcctcagtgcaagcataatataatcccacaggtcggagcggatcagcgaggacacctccccgccaggaaccaactcaacggagcctatgctgattataatacgcatattcggagctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacgaccacagaaaaatgcacaatttttctctcaaacatgactgcgagccctgcaaaaaataaaaaagaaacattacacaagagtagcctgtcttacgatgggatagactactctaaccaacataagacgggccacaacatcgcccgcgtggccataaaaaaaattgtccgtgtgattaaaaagaagcacagatagctggccagtcatatccggagtcatcacgtgtgaacccgtgtagacccccgggttggacacatcggccaaagaaagaaagcggccaatgtacccaggaggaattataacactaagacgaagatacaacagaataaccccatgagggggaataacaaagttagtaggtgaataaaaacgataaacacccgaaactccctcctgcgtaggcaaaatagcaccctccccttccaaaacaacatatagcgcttccacagcagccatgacaaaagactcaaaacactcaaaagactcagtcttaccaggaaaataaaagcactctcacagcaccagcactaatcagagtgtgaaaagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccgctttctcacgatacgtcacttccgcaagaaaagcaaaactacatttcccacatgtgtaaaaacgaaaccccgccccttctaaccgcccacaacttacatcatcaaaacgtaaagtcctacgtcacccgccccgcctctccccgcccacctcattatcatattggccacaatccaaaataaggtatattat

SEQ ID NO: 25 - DNA, 37211 bp, Gorilla beringei graueri
catcatcaataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagtgcgtaatatttaccgagggccgagggactttgaccgattacgtggaggactcgcccaggtgttttttacgtgaatttccgcgttccgggtcaaagtctccgttttattgtcaccgtcatttgacgcggagggtatttaaacccgctgcgctcctcaagaggccactcttgagtgccagcgagaagagttttctcctctgctccgcttcggtgatcgaaaaatgagacacatagcctgcactccgggtcttttgtccggtcgggcggcggccgagcttttggacgctttgatcaatgatgtcctgagcgatgattttccgtctactacccactttagcccacctactcttcacgaactgtacgatctggatgtactggtggatgtgaacgatcccaacgaggaggcggtttctgcgttttttcccgagtctgcgctgttggccgctcaggagggatttgacctacacactccgccgcctattttagagtctccgctgccggagcccagtggtataccttatatgcctgaactgcttcccgaagtggtagacctgacctgccacgagcctggctttccgcccagcgacgatgatggtgagccttttgttttagactttgctgagatacctgggcacggttgcaggtcttgtgcatatcatcagagggttaccggagaccccgaggttaagtgttcgctgtgctatatgaggatgacctcttcctttatctacagtaagtttttgtctaggtgggcttttgggtaggtgggttttgtgtcagaacaggtgtaaacgttgcttgtgttttttgtacctgtaggtccggtgtccgagccagacccggagcccgaccgcgatcccgagccggatcccgagcctcctcgtagggcaagaaaattaccttctattctgtgcaagtctaagacacctgtgaggaccagcgaggcggacagcaccgactctggcacttctacctctcctcctgaaattcacccagtggttcctctgggtatacatagacctgttgctgttagagtttgcgggcgacgctctgcagtagagtgcattgaggacttgcttcacgaacccgaggaacctttggacttgagcgttaaacgccctaggcaataaaccccacctaagtaataaaccccacctaagtaataaaccctgccgcccttggttattgagatgacgcccaatgtttgcttttgaatgacttcatgtgtgtaataaaagtgagtgtgatcataggtctcttgtttgtctgggcggggcttaagggtatataagtctcttggggctaaacttggttacacttgaccccaatggaggcgtgggggtgcttggaggagtttgcggacgtgcgccgtttgctggacgagagctctagcaatacctatactatttggaggtatctgtggggctctactcaggccaagttggtctccagaattaagcaggattacaagtgcgattttgaagagctttttagttcctgcggtgagcttttgcaatccttgaatctgggccatcaggctattttccaggaaaaggttctctcgactttggatttttccactcccgggcgcaccgccgcttgtgtggcttttgtgtcttttgtgcaagataaatggagcgaggagacccacctgagtcacggctacgtactggatttcatggcgatggctctttggagggcttacaacaaatggaagattcagaaggaactgtacggttccgccctacgtcgtccacttctgtcgcgacaggggctgaggtttcccgaccatcggcagcatcagaatctggaagacgagtcggaggagcgagcggaggagaagatcagcttgagagccggcctggaccctcctcaggaggaatgaatctcccgcaggtggttgacctgtttccagaactgagacgggtcctgactatcagggaggatggtcagtttgtgaagaagtttaagagggatcggggtgagggagatgatgaggcggctagcaatttagcttttagtctgatgactcgccaccgaccggaatgtattacctatcagcagattaaggagagttgtgccaacgagctggatcttttgggtcagaagtatagcatagaacagcttaccacttactggcttcagcctggggatgattgggaagaggcgatcagggtgtatgcaaaggtggccctgcggcccgattgcaagtataagattactaagttggttaatattagaaactgctgctatatttctgggaacggggccgaagtggagatagatactcaggacagggtggcttttaggtgttgcatgataaacatgtggcccgggatactggggatggatggggtggtattcatgaatgtgaggtttacgggccccaactttaatggcacggtgttcatgggcaacaccaacttgctcctgcatggtgcgagtttctatgggtttaataacacctgtatagaggcctggaccgatgtaaaggttcgaggttgttccttttatagctgttggaaggcggtggtgtgtcgccctaaaagcaggggttctgtgaaaaaatgcttgtttgaaaggtgcaccttaggcatcctctctgagggcaactccagggtgcgccataatgtggcttcgaactgcggttgcttcatgcaagtgaagggggtgagcgttatcaagcataactcggtgtgtggaaactgcgaggatcgcgcctcccagatgctgacctgctttgatggcaactgtcacctgttgaagaccattcatataagcagccaccccagaaaggcctggcccgtgtttgagcataacatcttgacccgctgctccttgcatctgggggtcaggaggggtatgttcctgccttaccagtgtaactttagccacactaaaatcctgctggaacccgagtgcatgaccaaggtcagcctgaatggtgtgtttgatgtgactctgaaaatctggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgcaccagggccgagtttgggtctagcgatgaggataccgattgaggtgggtaaggtgggcgtggctagaagggtggggcgtgtataaattgggggtctaagggtctctctgttttgtcttgcaacagccgccgccatgagcgacaccggcaacagctttgatggaagcatctttagcccctatctgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcggcgcggcctctcgcgcgtctgctcgggatgagaaactgaccgctctgctgcttaaactggaagacttgacccgggagctggctcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtacacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataggacatctttacaaatcgggggcggagggtcccggactgggggatgatggtgccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagtctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtctccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcaccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtccggaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaagcaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgttgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacaggcatgggcggcaggggcacgtcttcgccgcgcgcgggcaggggctggtgctggctccgaagagcgcttgcgtgcgcgacgacgcgacggttggtgtcctgtatctgacgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcttcctggagatctcctcgtccggcgcgctccacggtggccgccaggtcgttggagatgcgacccatgagctgcgagaaggcgttgagcccgccctcgttccagacccggctgtagaccacgcccccctcggcgttgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacaccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggttttccagcatgaggcggtggtatccgtagatgtacctggacatccaggtgatgccggcggcggtggtggtggcgcgcgcgtagtcgcggacccggttccagatgtttcgcaggggcgagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttgaatcggccggaaccgcggctaacgagggccgtggcagccccgtcctcaggaccccgccagccgacttctccagttacgggagcgagccccttttgttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtgaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggccgatgaccaggaagaggaggactatgagctagaggagggcgagtacctggaggactgacctggctggtggtgttttggtatagatgcaagatccgaacgtggcggacccggcggtccgggcggcgctgcaaagccagccgtccggcattaactcctctgacgactgggccgcggccatgggtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggacgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttcaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggagacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacccaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcatcaaccgcctgatggactacttgcatcgggcggcggccgtgaaccccgagtacttcactaatgccattctgaatccccactggatgccccctccgggtttctacaacggggactttgaggtgcccgaggtcaacgacgggttcctctgggatgacatggatgacagtgtgttctcacccaacccgctgcgcgccgcgtctctgcgattgaaggagggctctgacagggaaggaccgagaagtctggcctcctccctggctctgggagcggtgggcgccacgggcgcggcggcgcggggcagtagccccttccccagcctggcagactctctgaacagcgggcgggtgagcaggccccgcttgctaggcgaggaggagtatctgaacaactccctgctgcagcccgcgagggacaagaacgctcagcggcagcagtttcccaacaatgggatagagagcctggtggacaagatgtccagatggaagacgtatgcgcaggagtacaaggagtgggaggaccgccagccgcggcccttgccgccccctaggcagcgctggcagcggcgcgcgtccaaccgccgctggaggcaggggcccgaggacgatgatgactctgcagatgacagcagcgtgttggacctgggcgggagcgggaaccccttttcgcacctgcgcccacgcctgggcaagatgttttaaaagaaaaaaaaaaaataaaactcaccaaggccatggcgacgagcgttggttttttgttcccttccttagtatgcggcgcgcggcgatgttcgaggaggggcctcccccctcttacgagagcgcgatggggatttctcctgcggcgcccctgcagcctccctacgtgcctcctcggtacctgcaacctacaggggggagaaatagcatctgttactctgagctgcagcccctgtacgataccaccagactgtacctggtggacaacaagtccgcggacgtggcctccctgaactaccagaacgaccacagcgattttttgaccacggtgatccaaaacaacgacttcaccccaaccgaggccagcactcagaccataaacctggataacaggtcgaactggggcggcgacctgaagaccatcttgcacaccaacatgcccaacgtgaacgagttcatgttcaccaactcttttaaggcgcgggtgatggtggcgcgcgagcagggggaggcgaagtacgagtgggtggacttcacgctgcccgagggcaactactcagagaccatgactctcgacctgatgaacaatgcgatcgtggaacactatctgaaagtgggcaggcagaacggggtgaaggaaagcgatatcggggtcaagtttgacaccagaaacttccgtctgggctgggaccccgtgaccgggctggtcatgccgggggtctacaccaacgaggcctttcatcccgacatagtgcttctgcccggctgtggggtggacttcacccagagccggctgagcaacctgctgggcattcgcaagcggcagcctttccaggagggtttcaagatcacctatgaggatctgaaggggggcaacattcccgcgctccttgatctggacgcctacgaggagagcttgaaacccgaggagagcgctggcgacagcggcgagagtggcgaggagcaagccggcggcggtggcggcgcgtcggtagaaaacgaaagtacgcccgcagtggcggcggacgctgcggaggtcgagccggaggccatgcagcaggacgcagaggagggcgcacaggagggcgcgcagaaggacatgaacgatggggagatcaggggagacacattcgccacccggggcgaagaaaaagaggcagaggcggcggcggcggcgacggcggaggccgaaaccgaggttgaggcagaggcagagcccgagaccgaagttatggaagacatgaatgatggagaacgtaggggcgacacgttcgccacccggggcgaagagaaggcggcggaggcagaagccgcggctgaggaggcggctgcggctgcggccaagactgaggctgcggctaaggctgaggtcgaagccaatgttgcggttgaggctcaggctgaggaggaggcggcggctgaagcagttaaggaaaaggcccaggcagagcaggaagagaaaaaacctgtcattcaacctctaaaagaagatagcaaaaagcgcagttacaacgtcatcgagggcagcacctttacccagtaccgcagctggtacctggcgtacaactacggcgacccggtcaagggggtgcgctcgtggaccctgctctgcacgccggacgtcacctgcggctccgagcagatgtactggtcgctgccgaacatgatgcaagacccggtgaccttccgctccacgcggcaggttagcaacttcccggtggtgggcgccgaactgctgcccgtgcactccaagagtttttacaacgagcaggccgtctactcccagctgatccgccaggccacctctctgacccacgtgttcaatcgctttcccgagaaccagattttggcgcgcccgccggcccccaccatcaccaccgtgagtgaaaacgttcctgccctcacagatcacgggacgctaccgctgcgcaacagcatctcaggagtccagcgagtgaccattactgacgccagacgccggacctgcccctacgtttacaaggccttgggcatagtctcgccgcgcgtcctctccagtcgcactttttaaaacacatctacccacacgttccaaaatcatgtccgtactcatctcacccagcaacaacaccggctgggggctgcgcgcgcccagcaagatgtttggaggggcgaggaagcgctccgaccagcaccctgtgcgcgtgcgcggccactaccgcgcgccctggggagcgcacaagcgcgggcgcacagggcgcaccactgtggacgacgtcattgactccgtagtggagcaagcgcgccactacacacccggcgcgccgaccgcccccgccgtgtccaccgtggaccaggcgatcgaaagcgtggtacagggcgcgcggcactatgccaaccttaaaagtcgccgccgccgcgtggcccgccgccatcgccggagaccccgggccaccgccgccgcgcgccttactaaggctctgctcaggcgcgccaggcgaactggccaccgggccgccatgagggccgcacggcgggctgccgctgccgcaagcgccgtggccccgcgggcacgaaggcgcgcggccgccgccgccgccgccgccatttccagcttggcctcgacgcggcgcggtaacatatactgggtgcgcgactcggtaaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgatgacgaggcggtggagtttgtccgccgcatggcacccaggcgccccgtgcagtggaagggccggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtaaccctgcaacaggtgctgcctttgagcgcgcccagcgagcataagcgagggttgaagcgcgaaggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcggcggccagcgccaccaccggcaccgcttcggtagaggtgcagacggacccctggctacccgccaccgctgttgccgccgccgccccccgttcgcgcgggcgcaagagaaattatccagcggccagcgcgctcatgccccagtacgcactgcatccatccatcgcgcccacccccggctaccgcgggtactcgtaccgcccgcgcagatcagccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcattttttggaggaaaaataaaaaaagtctagactctcacgctcgcttggtcctgtgactattttgtagaaaaaagatggaagacatcaactttgcgtcgctggccccgcgtcacggctcgcgcccgttcatgggagactggacagatatcggcaccagcaatatgagcggtggcgccttcagctggggcagtctgtggagcggccttaaaaattttggttccaccattaagaactatggcaacaaagcgtggaacagcagcacgggccagatgctgagagacaagttgaaagagcagaacttccaggagaaggtggcgcagggcctggcctctggcatcagcggggtggtggacatagctaaccaggccgtgcagaaaaagataaacagtcatctggacccccgtcctcaggtggaggaaatgcctccagcgatggagacggtgtctcccgagggcaaaggcgaaaagcgcccgcggcccgacagagaagagaccctggtgtcacacaccgaggagccgccctcttacgaggaggcagtcaaggccggcctgcccaccactcgccccatagcccccatggccaccggtgtggtgggccacaggcaacacactcccgcaacactagatctgcccccgccgtccgagccgccgcgccagccaaaggcggcgacggtgcccgctccctccacttccgccgccaacagagtgcccctgcgccgcgccgcgagcggcccccgggcctcgcgagttagcggcaactggcagagcacactgaacagcatcgtgggcctgggagtgaggagtgtgaagcgccgccgttgctactgaatgagcaagctagctaacgtgttgtatgtgtgtatgcgtcctatgtcgccgccagaggagctgttgagccgccggcgccgtctgcactccagcgaatttcaagatggcgaccccatcgatgatgcctcagtggtcgtacatgcacatctcgggccaggacgcttcggagtacctgagccccgggctggtgcagttcgcccgcgccacagacacctacttcaacatgagtaacaagttcaggaaccccactgtggcgcccacccacgatgtgaccacggaccggtcgcagcgcctgacgctgcggttcatccccgtggatcgggaggacaccgcctactcttacaaggcgcggttcacgctggccgtgggcgacaaccgcgtgctggacatggcctccacttactttgacatcaggggggtgctggacaggggccccaccttcaagccctactcgggtactgcctacaactccctggcccccaagggcgctcccaattcttgcgagtgggaacaagaggaaaatcaggtggtcgctgcagatgatgaacttgaagatgaagaagcgcaagctcaagaggacgccccagctaaaaaaattcatgtatatgcccaggcgcctcttgctggcgaaaagattaccaaggatggtttgcaaataggtactgaagttgtaggagatacatctaaggacacttttgcagacaaaacattccaacccgaacctcagataggcgagtctcagtggaacgaggctgatgccacagtagcaggaggcagagtcttgaaaaaaaccacccctatgagaccttgctatggatcctatgccaggcctacaaatgccaacgggggtcaaggaattatggttgccaatgaacaaggagtgttggagtctaaagtggagatgcaatttttttctaacactacaacccttaatgcgcgggatggagctggcaatcccgaaccaaaggtggtgttgtacagtgaagatgtccacttggaatctcctgacactcatttgtcttacaagcccaaaaaggatgatgttaatgctaaaattatgttgggtcagcaagctatggctaacaggcccaacctcattgcttttagagataatttcattggactcatgtactacaacagcactggtaacatgggagtgctggcgggtcaggcctctcagttgaatgccgtggtggacctgcaggatagaaacacagaactgtcatatcagcttatgcttgattccattggggatagatccagatacttctccatgtggaaccaggcagtggatagctatgacccagatgtcagaatcattgaaaaccatggtgtcgaggacgagctacccaactactgcttccctctgggcggcataggaattactgatacttatcaagggatcaaaaataccaatggcaatggtcagtggaccaaagatgatcagttcgcggaccgtaatgaaataggggtgggaaacaacttcgccatggagatcaacatccaggccaacctctggaggaacttcctctatgcgaacgtggggctctacctgccagacaagctcaagtacaaccccaccaacgtggacatctctgacaaccccaacacctatgactacatgaacaagcgtgtggtggctcccggcctggtggactgctttgtcaatgtgggagccaggtggtccctggactacatggacaacgtcaaccccttcaaccaccaccgcaatgcgggtctgcgctaccgctccatgatcctgggcaacgggcgctacgtgcccttccacattcaggtgccccagaagttctttgccatcaagaacctcctcctcctgccgggctcctacacttacgagtggaacttcaggaaggatgtcaacatggtcctgcagagctctctgggcaatgaccttagggtggacggggccagcatcaagtttgacagcgtcaccctctatgctaccttcttccccatggctcacaacaccgcctccacgctcgaggccatgctgaggaacgacaccaacgaccagtccttcaatgactacctctctggggccaacatgctctaccccatccccgccaaggccaccaacgtgcccatctccattccctctcgcaactgggccgccttcagaggctgggcctttacccgccttaagaccaaggaaaccccctccctgggctcgggttttgacccctactttgtctactcgggatccatcccctacctggatggcaccttctacctcaaccacacttttaagaagatatccatcatgtatgactcctccgtcagctggccgggcaatgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccattggcatcactcaccagcacaacaactcgggattcgtgggctacctggctcccaccatgcgcgaggggcaggcctaccccgccaacttcccctacccgttgataggcaagaccgcggtcgacagcgtcacccagaaaaagttcctctgcgaccgcaccctctggcgcatccccttctctagcaacttcatgtccatgggtgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacctgctacctcttcgacccctttggcttctccgatcagcgcctcagacagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcacatccggggggccacctctttctgccacttgcaacaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggctcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattacgcacgctggccagcaggctctcgtcgctgatcatgtcgctgtccagatcctccgcgttgctcagggcgaatggggtcatcttgcagacctgcctgcccaggaaaggcggcagcccgggcttgccgttgcagtcgcagcgcaggggcatcagcaggtgcccgtggcccgtctgcgcctgcgggtacagcgcgcgcatgaaggcttcgatctgcctgaaagccacctgcgtcttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtcccgtgcagacacttcaggtcgccctccgtctgggtgcagcggtgctcccacagcgcgcaaccggtgggctcccaatttttgtgggtcacccccgcgtaggcctgcaggtaggcctgcaagaagcgccccatcatggccacaaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagctccgcctgctcttcttcgtcttcgctgtctaccactatctctggggaagggcttctccgctctgcggcggtgcgcttcttttttttcttgggagcagccgtgacggagtccgccacggcgacggaggtcgagggcgtggggctgggggtgcgcggtaccagggcctcgtcgccctcggactcttcctctgactccaggcggcggcggagacgcttctttgggggcgcgcgcgtcagcggcggcggagacggggacggggacggggacgggacgccctccacagggggtggtcttcgcgcagacccgcggccgcgctcgggggtcttttcgagctggtcttggtcccgactggccattgtatcctcctcctcctaggcagagagacataaggagtctatcatgcaagtcgagaaggaggagagcttaaccaccccctctgagaccgccgatgcgcccgccgtcgccgtcgcccccgctgccgccgacgcgcccgccacaccgagcgacacccccgcggaccccccagccgacgcacccctgttcgaggaagcggccgtggagcaggacccgggctttgtctcggcagaggaggatttgcgagaggaggaggataaggagaagaagccctcagtgccaaaagatgataaagagcaagacgagcacgacgcagatgcacaccagggtgaagtcgggcggggggacggagggcatgacggcgccgactacctagacgaagggaacgacgtgctcttgaagcacctgcatcgtcagtgcgccatcgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgcctttgtggtgcccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtgccaaagatcttcgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctcaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgcggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgcctggaggagcgcaacctcaaggagctggagaagctcctgcagcgcgcgctcaaagacctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaagaccaatcccgcccgcccaaggcggagctgaccgcctgcgtcatcacccagggcgagatcctaggccaattgcaagccatccaaaaagcccgccaagattttttgctgagaaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgagaaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcaattaccaccacgccccgcaataatcccaaccccagggagtggcccgcgtccctggtgtatcaggaaattcccggccccaccaccgtactacttccgcgtgattcccaggccgaagtccaaatgactaactcaggggcgcagctcgcgggcggctgtcgtcacagggtgcggcctcctcgccagggtataactcacctggagatccgaggcagaggtattcagctcaacgacgagtcggtgagctcctcgctcggtctaagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctcgggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgaggaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgactttatagagccccagtgtaacgtgacttttaaagcccatgcacagcgttgtcatactataatcaaatgtgccaccgaacacgatgaataccttatccagtataaagataaatcacacaaagtggcacttgttgacatctggaaacccgaagaccctttggaatacaatgtgaccgttttccagggtgacctcttcaaaatttacaattacactttcccatttgaccagatgtgtgactttgtcatgtacatggaaaagcagcacaagctgtggcctccgactccccagggctgtgtggaaaatccaggctctttctgcatgatctctctctgtgtaactgtgctggcactaatactcacgcttttgtatatcagatttaaatcaaggcaaagcttcatcgatgaaaagaaaatgccttaaacgctttcacgcttgattgctaacaccgggtttttatccgcagaatgattggaatcaccctactaatcacctccctccttgcgattgcccatgggttggaacgaatcgaagcccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatctaaccttgattgatgttcaaatgctggatgcgggctactattatgggcagctgggtacaatgattaattactggagaccccacaaagattacatgctccacgtagtaaagggtccccttagcagcccacccactaccacctctactacccccactaccaccactactcccaccaccagcactgccgcccagcctcctcatagcagaacaaccacttttatcaattccaagtcccactccccccacattgccggcgggccctccgcctcagactccgagaccaccgagatctgcttctgcaaatgctctgacgcctttgctgaggatttggaagaccacgaggaagatgagcatgacttcgcagatgcatgccaggcatcagaggcagaagcgctgccggtggccctcaaacagtatgcagacccccacaccacccccaaccttcctccaccttcccagaagccaagtttcctgggggaaaatgaaactctgcctctctccatactcgctctgacatctgttgctatgttgaccgctctgctggtgcttctatgctctatatgctacctgatctgctgcagaaagaaaaaatctcacggccatgctcaccagcccctcatgcacttcccttaccctccagagctgggcgaccacaaactttaagtctgcagtaactatctgcccatcccttgtcagtcgacagcgatgagccccactaatctaacggcctctggacttacaacatcgtctcttaatgagaccaccgctcctcaagacctgtacgatggtgtctccgcgctggttaaccagtgggatcacctgggcatatggtggctcctcataggagcagtgaccctgtgcctaatcctggtctggatcatctgctgcatcaaaagcagaagacccaggcggcggcccatctacaggccctttgtcatcacacctgaagatgatgatgacaccacttccaggctgcagaggctaaagcagctactcttctcttttacagcatggtaaattgaatcatgcctcgcattttcatctacttgtctctccttccactttttctgggctcttctacattggccgctgtgtcccacatcgaggtagactgcctcacgcccttcacagtctacctgcttttcggctttgtcatctgcacctttgtctgcagcgttatcactgtagtgatctgcttcatacagtgcatcgactacgtctgcgtgcgggtggcttactttagacaccacccccagtatcgcaacagggacatagcggctctcctaagacttgtttaaaatcatggccaaattaactgtgattggtcttctgatcatctgctgcgtcctagccgcgattgggactcaagctcctaccaccaccagcgctcccagaaagagacatgtatcctgcagcttcaagcgtccctggaatataccccaatgctttactgatgaacctgaaatctctttggcttggtacttcagcgtcaccgcccttcttatcttctgcagtacggttattgcccttgccatctacccttcccttgacctgggctggaatgctgtcaactctatggaatatcccaccttcccagaaccagacctgccagacctggttgttctaaacgcgtttcctcctcctgctcccgttcaaaatcagtttcgccctccgtcccccacgcccactgaggtcagctactttaatctaacaggcggagatgactgaaaacctagacctagaaatggacggtctctgcagcgagcaacgcacactagagaggcgccggcaaaaagagctcgagcgtcttaaacaagagctccaagacgcggtggccatacaccagtgcaaaaaaggtgtcttctgtctggtaaaacaggccacgctcacctatgaaaaaacaggtgacacccaccgcctaggatacaagctgcccacacagcgccagaagttcgccctcatgataggcgaacaacccatcaccgtgacccagcactccgtggagacagaaggctgcatacacgctccctgtaggggcgctgactgcctctacaccttgatcaaaaccctctgcggtctcagagacctcatcccttttaattaatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtccctttccttacccctccctttgtgtcatccgcaggaatgcaagaaaatccagctggggtgctgtccctgcacttgtcagagccccttaccacccacaatggggccctgactctaaaaatggggggcggcctgaccctggacaaggaagggaatctcacttcccaaaacatcaccagtgtcgatccccctctcaaaaaaagcaagaacaacatcagccttcagaccgccgcacccctcgccgtcagctccggggccctaacactttttgccactccccccctagcggtcagtggtgacaaccttactgtgcagtctcaggcccctctcactttggaagactcaaaactaactctggccaccaaaggacccctaactgtgtccgaaggcaaacttgtcctagaaacagaggctcccctgcatgcaagtgacagcagcagcctgggccttagcgttacggccccacttagcattaacaatgacagcctaggactagacatgcaagcgcccattagctctcgagatggaaaactggctctaacagtggcggcccccctaactgtggtcgagggtatcaatgctttggcagtagccacaggtaagggtattgggctaaatgaaaccaacacacacctgcaggcaaaactggtcgcacccctaggctttgataccaacggcaacattaagctaagcgttgcaggaggcatgaggctaaacaataacacactgatactagatgtaaactacccatttgaggctcaaggccaactgagcctaagagtgggctcgggcccactatatgtagattctagtagtcataacctaaccattagatgccttaggggattgtatataacatcttctaacaaccaaaacggtctagaagccaacattaaactaacaagaggccttgtgtatgacggaaatgccatagcagttaatgttggcaaagggctggaatacagccctactgacacaacagaaaaacctatacagactaaaataggtctaggcatggagtatgataccgagggagccatgatgacaaaactaggctctggactaagctttgacaattcaggagccattgtagtgggaaacaaaaatgatgacaggcttactttgtggaccacaccggacccatcgcccaactgtcagatctactctgaaaaagatgctaaactaaccttggtactgactaaatgtggcagtcaggttgtaggcacagtatctattgccgctcttaaaggtagcctcgtgccaatcactagtgcaatcagtgtggttcaggtatacctaaggtttgatgaaaatggggtactaatgagtaactcttcacttaatggcgaatactggaattttagaaacggagactcaactaatggcacaccatatacaaacgcagtgggtttcatgcctaatctactggcctatcctaaaggtcaaactacaactgcaaaaagtaacattgtcagccaggtctacatgaatggggacgatactaaacccatgacatttacaatcaacttcaatggccttagtgaaacaggggatacccctgttagtaaatattccatgacattctcatggaggtggccaaatggaagctacatagggcacaattttgtaacaaactcctttaccttctcctacatcgcccaagaataaagaaagcacagagatgcttgtttttgatttcaaaattgtgtgcttttatttattttcagcttacagtatttccagtagtcattcaaataaagcttaatcaaactgcatgagaacccttccacatagcttaaattagcaccagtgcaaatggagaaaaatcaacatacctttttttatccagatatcagagaactctagtggtcagttttcccccaccctcccagctcacagaatacacagtcctttccccccggctggctttaaacaacactatctcattggtaacagacatattcttaggtgtaataatccacacggtctcttggcgggccaaacgctggtcggtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgcagcaacaaggcgcgcagcaactcctgccgccgcctctccgtacggcaggaatgcaacggcgtggtggtctcctccgtgataatccgcaccgctcgcagcatcagcatcctcgtcctccgggcacagcagcgcatcctgatctcactgagatcggcgcagtaagtgcagcacaaaaccaagatgttatttaagatcccacagtgcaaagcactgtacccaaagctcatggcgggaaggacagcccccacgtgaccatcataccagatcctcaggtaaatcaaatgacgacctctcataaacacgctggacatgtacatcacctccttgggcatgtgctgattcaccacctctcgataccacaagcatcgctgattaattaaagacccctcgagcaccatcctaaaccaggaagccagcacctgaccccccgccaggcactgcagggaccccggtgaatcgcagtggcagtgaagactccagcgctcgtagccgtgaaccatagagctggtcattatatccacattggcacaacacagacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgttcggtgtagtagttgtaatacagccactccctgagaccgtcaaggcgctccctggcgtccggatctatgacaacaccgtcctgcagcgccgccctgatgacatccaccaccgtagagtatgccaagcccagccaggaaatgcattcactttgacagcgagagataggaggagcggggagagatggaagaaccatgatagtaaagagaacttttattccaatcgatcttctaagatatcaaagtggagatctataagatgacactggtctcctccgctgagtcgatcaaaaataacagctaaaccacaaacaacacgattggtcaaatgctccacaagggcctgcagcataaaattgcctcggaactccaccgcaagcataacatcaaagccaccgcctctatcgtgatcaagaataaaaaccccacagctatccaccagacccatatagttttcatctctccatcgtgaaaaaagatttacaagctcctcctttaaatcacctccaaccaattgaaaaagttgaaccagaccgccctccaccttcattttcagcaagcgtatcatgattgcaaaaattcaggctcctcagacacctgtataagattgagaagcggaacgttaacatcgatgtttcgctcgcgtaaatcacgcctcagtgcaagcataatataatcccacaggtcggagcggatcagcgaggacacctccccgccaggaaccaactcaacggagcctatgctgattataatacgcatattcggagctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacaaccacagaaaaatgcacaatttttctctcaaacatgactgcgagccctgcaaaaaataaaaaagaaacattacacaagagtagcctgtcttacgatgggatagactactctaaccaacataagacgggccacaacatcgcccgcgtggccataaaaaaaattgtccgtgtgattaaaaagaagcacagatagctggccagtcatatccggagtcatcacgtgtgaacccgtgtagacccccgggttggacacatcggccaaagaaagaaagcggccaatgtacccaggaggaattataacactaagacgaagatacaacagaataaccccatgagggggaataacaaagttagtaggtgaataaaaacgataaacacccgaaactccctcctgcgtaggcaaaatagcaccctccccttccaaaacaacatatagcgcttccacagcagccatgacaaaagactcaaaacactcaaaagactcagtcttaccaggaaaataaaagcactctcacagcaccagcactaatcagagtgtgaagagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccgctttctcacggtacgtcacttccgcaagaaaagcaaaactacatttcccacatgtgtaaaaacgaaaccccgccccttgtaaccgcccacaacttacatcatcaaaacgtaaactcctacgtcacccgccccgcctctccccgcccacctcattatcatattggccacaatccaaaataaggtatattattgatgatg

SEQ ID NO: 26 - DNA, 37213 bp, Gorilla beringei graueri
catcatcaataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagtgcgtaatatttaccgagggccgagggactttgaccgattacgtggaggactcgcccaggtgttttttacgtgaatttccgcgttccgggtcaaagtctccgttttattgtcaccgtcatttgacgcggagggtatttaaacccgctgcgctcctcaagaggccactcttgagtgccagcgagaagagttttctcctctgctccgcttcggtgatcgaaaaatgagacacatagcctgcactccgggtcttttgtccggtcgggcggcggccgagcttttggacgctttgatcaatgatgtcctgagcgatgattttccgtctactacccactttagcccacctactcttcacgaactgtacgatctggatgtactggtggatgtgaacgatcccaacgaggaggcggtttctgcgttttttcccgagtctgcgctgttggccgctcaggagggatttgacctacacactccgccgcctattttagagtctccgctgccggagcccagtggtataccttatatgcctgaactgcttcccgaagtggtagacctgacctgccacgagcctggctttccgcccagcgacgatgatggtgagccttttgttttagactttgctgagatacctgggcacggttgcaggtcttgtgcatatcatcagagggttaccggagaccccgaggttaagtgttcgctgtgctatatgaggatgacctcttcctttatctacagtaagtttttgtctaggtgggcttttgggtaggtgggttttgtgtcagaacaggtgtaaacgttgcttgtgttttttgtacctgtaggtccggtgtccgagccagacccggagcccgaccgcgatcccgagccggatcccgagcctcctcgtagggcaagaaaattaccttctattctgtgcaagtctaagacacctgtgaggaccagcgaggcggacagcaccgactctggcacttctacctctcctcctgaaattcacccagtggttcctctgggtatacatagacctgttgctgttagagtttgcgggcgacgctctgcagtagagtgcattgaggacttgcttcacgaacccgaggaacctttggacttgagcgttaaacgccctaggcaataaaccccacctaagtaataaaccccacctaagtaataaaccctgccgcccttggttattgagatgacgcccaatgtttgcttttgaatgacttcatgtgtgtaataaaagtgagtgtgatcataggtctcttgtttgtctgggcggggcttaagggtatataagtctcttggggctaaacttggttacacttgaccccaatggaggcgtgggggtgcttggaggagtttgcggacgtgcgccgtttgctggacgagagctctagcaatacctatactatttggaggtatctgtggggctctactcaggccaagttggtctccagaattaagcaggattacaagtgcgattttgaagagctttttagttcctgcggtgagcttttgcaatccttgaatctgggccatcaggctattttccaggaaaaggttctctcgactttggatttttccactcccgggcgcaccgccgcttgtgtggcttttgtgtcttttgtgcaagataaatggagcgaggagacccacctgagtcacggctacgtactggatttcatggcgatggctctttggagggcttacaacaaatggaagattcagaaggaactgtacggttccgccctacgtcgtccacttctgtcgcgacaggggctgaggtttcccgaccatcggcagcatcagaatctggaagacgagtcggaggagcgagcggaggagaagatcagcttgagagccggcctggaccctcctcaggaggaatgaatctcccgcaggtggttgacctgtttccagaactgagacgggtcctgactatcagggaggatggtcagtttgtgaagaagtttaagagggatcggggtgagggagatgatgaggcggctagcaatttagcttttagtctgatgactcgccaccgaccggaatgtattacctatcagcagattaaggagagttgtgccaacgagctggatcttttgggtcagaagtatagcatagaacagcttaccacttactggcttcagcctggggatgattgggaagaggcgatcagggtgtatgcaaaggtggccctgcggcccgattgcaagtataagattactaagttggttaatattagaaactgctgctatatttctgggaacggggccgaagtggagatagatactcaggacagggtggcttttaggtgttgcatgataaacatgtggcccgggatactggggatggatggggtggtattcatgaatgtgaggtttacgggccccaactttaatggcacggtgttcatgggcaacaccaacttgctcctgcatggtgcgagtttctatgggtttaataacacctgtatagaggcctggaccgatgtaaaggttcgaggttgttccttttatagctgttggaaggcggtggtgtgtcgccctaaaagcaggggttctgtgaaaaaatgcttgtttgaaaggtgcaccttaggcatcctctctgagggcaactccagggtgcgccataatgtggcttcgaactgcggttgcttcatgcaagtgaagggggtgagcgttatcaagcataactcggtgtgtggaaactgcgaggatcgcgcctcccagatgctgacctgctttgatggcaactgtcacctgttgaagaccattcatataagcagccaccccagaaaggcctggcccgtgtttgagcataacatcttgacccgctgctccttgcatctgggggtcaggaggggtatgttcctgccttaccagtgtaactttagccacactaaaatcctgctggaacccgagtgcatgaccaaggtcagcctgaatggtgtgtttgatgtgactctgaaaatctggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgcaccagggccgagtttgggtctagcgatgaggataccgattgaggtgggtaaggtgggcgtggctagaagggtggggcgtgtataaattgggggtctaagggtctctctgttttgtcttgcaacagccgccgccatgagcgacaccggcaacagctttgatggaagcatctttagcccctatctgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcggcgcggcctctcgcgcgtctgctcgggatgagaaactgaccgctctgctgcttaaactggaagacttgacccgggagctggctcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtacacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataggacatctttacaaatcgggggcggagggtcccggactgggggatgatggtgccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagtctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtctccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcaccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtccggaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaagcaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgttgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacaggcatgggcggcaggggcacgtcttcgccgcgcgcgggcaggggctggtgctggctccgaagagcgcttgcgtgcgcgacgacgcgacggttggtgtcctgtatctgacgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcttcctggagatctcctcgtccggcgcgctccacggtggccgccaggtcgttggagatgcgacccatgagctgcgagaaggcgttgagcccgccctcgttccagacccggctgtagaccacgcccccctcggcgttgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacaccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggttttccagcatgaggcggtggtatccgtagatgtacctggacatccaggtgatgccggcggcggtggtggtggcgcgcgcgtagtcgcggacccggttccagatgtttcgcaggggcgagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttgaatcggccggaaccgcggctaacgagggccgtggcagccccgtcctcaggaccccgccagccgacttctccagttacgggagcgagccccttttgttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtgaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggccgatgaccaggaagaggaggactatgagctagaggagggcgagtacctggaggactgacctggctggtggtgttttggtatagatgcaagatccgaacgtggcggacccggcggtccgggcggcgctgcaaagccagccgtccggcattaactcctctgacgactgggccgcggccatgggtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggacgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttcaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggagacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacccaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcatcaaccgcctgatggactacttgcatcgggcggcggccgtgaaccccgagtacttcactaatgccattctgaatccccactggatgccccctccgggtttctacaacggggactttgaggtgcccgaggtcaacgacgggttcctctgggatgacatggatgacagtgtgttctcacccaacccgctgcgcgccgcgtctctgcgattgaaggagggctctgacagggaaggaccgagaagtctggcctcctccctggctctgggagcggtgggcgccacgggcgcggcggcgcggggcagtagccccttccccagcctggcagactctctgaacagcgggcgggtgagcaggccccgcttgctaggcgaggaggagtatctgaacaactccctgctgcagcccgcgagggacaagaacgctcagcggcagcagtttcccaacaatgggatagagagcctggtggacaagatgtccagatggaagacgtatgcgcaggagtacaaggagtgggaggaccgccagccgcggcccttgccgccccctaggcagcgctggcagcggcgcgcgtccaaccgccgctggaggcaggggcccgaggacgatgatgactctgcagatgacagcagcgtgttggacctgggcgggagcgggaaccccttttcgcacctgcgcccacgcctgggcaagatgttttaaaagaaaaaaaaaaaaataaaactcaccaaggccatggcgacgagcgttggttttttgttcccttccttagtatgcggcgcgcggcgatgttcgaggaggggcctcccccctcttacgagagcgcgatggggatttctcctgcggcgcccctgcagcctccctacgtgcctcctcggtacctgcaacctacaggggggagaaatagcatctgttactctgagctgcagcccctgtacgataccaccagactgtacctggtggacaacaagtccgcggacgtggcctccctgaactaccagaacgaccacagcgattttttgaccacggtgatccaaaacaacgacttcaccccaaccgaggccagcactcagaccataaacctggataacaggtcgaactggggcggcgacctgaagaccatcttgcacaccaacatgcccaacgtgaacgagttcatgttcaccaactcttttaaggcgcgggtgatggtggcgcgcgagcagggggaggcgaagtacgagtgggtggacttcacgctgcccgagggcaactactcagagaccatgactctcgacctgatgaacaatgcgatcgtggaacactatctgaaagtgggcaggcagaacggggtgaaggaaagcgatatcggggtcaagtttgacaccagaaacttccgtctgggctgggaccccgtgaccgggctggtcatgccgggggtctacaccaacgaggcctttcatcccgacatagtgcttctgcccggctgtggggtggacttcacccagagccggctgagcaacctgctgggcattcgcaagcggcagcctttccaggagggtttcaagatcacctatgaggatctgaaggggggcaacattcccgcgctccttgatctggacgcctacgaggagagcttgaaacccgaggagagcgctggcgacagcggcgagagtggcgaggagcaagccggcggcggtggcggcgcgtcggtagaaaacgaaagtacgcccgcagtggcggcggacgctgcggaggtcgagccggaggccatgcagcaggacgcagaggagggcgcacaggagggcgcgcagaaggacatgaacgatggggagatcaggggagacacattcgccacccggggcgaagaaaaagaggcagaggcggcggcggcggcgacggcggaggccgaaaccgaggttgaggcagaggcagagcccgagaccgaagttatggaagacatgaatgatggagaacgtaggggcgacacgttcgccacccggggcgaagagaaggcggcggaggcagaagccgcggctgaggaggcggctgcggctgcggccaagactgaggctgcggctaaggctgaggtcgaagccaatgttgcggttgaggctcaggctgaggaggaggcggcggctgaagcagttaaggaaaaggcccaggcagagcaggaagagaaaaaacctgtcattcaacctctaaaagaagatagcaaaaagcgcagttacaacgtcatcgagggcagcacctttacccagtaccgcagctggtacctggcgtacaactacggcgacccggtcaagggggtgcgctcgtggaccctgctctgcacgccggacgtcacctgcggctccgagcagatgtactggtcgctgccgaacatgatgcaagacccggtgaccttccgctccacgcggcaggttagcaacttcccggtggtgggcgccgaactgctgcccgtgcactccaagagtttttacaacgagcaggccgtctactcccagctgatccgccaggccacctctctgacccacgtgttcaatcgctttcccgagaaccagattttggcgcgcccgccggcccccaccatcaccaccgtgagtgaaaacgttcctgccctcacagatcacgggacgctaccgctgcgcaacagcatctcaggagtccagcgagtgaccattactgacgccagacgccggacctgcccctacgtttacaaggccttgggcatagtctcgccgcgcgtcctctccagtcgcactttttaaaacacatctacccacacgttccaaaatcatgtccgtactcatctcacccagcaacaacaccggctgggggctgcgcgcgcccagcaagatgtttggaggggcgaggaagcgctccgaccagcaccctgtgcgcgtgcgcggccactaccgcgcgccctggggagcgcacaagcgcgggcgcacagggcgcaccactgtggacgacgtcattgactccgtagtggagcaagcgcgccactacacacccggcgcgccgaccgcccccgccgtgtccaccgtggaccaggcgatcgaaagcgtggtacagggcgcgcggcactatgccaaccttaaaagtcgccgccgccgcgtggcccgccgccatcgccggagaccccgggccaccgccgccgcgcgccttactaaggctctgctcaggcgcgccaggcgaactggccaccgggccgccatgagggccgcacggcgggctgccgctgccgcaagcgccgtggccccgcgggcacgaaggcgcgcggccgccgccgccgccgccgccatttccagcttggcctcgacgcggcgcggtaacatatactgggtgcgcgactcggtaaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgatgacgaggcggtggagtttgtccgccgcatggcacccaggcgccccgtgcagtggaagggccggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtaaccctgcaacaggtgctgcctttgagcgcgcccagcgagcataagcgagggttgaagcgcgaaggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcggcggccagcgccaccaccggcaccgcttcggtagaggtgcagacggacccctggctacccgccaccgctgttgccgccgccgccccccgttcgcgcgggcgcaagagaaattatccagcggccagcgcgctcatgccccagtacgcactgcatccatccatcgcgcccacccccggctaccgcgggtactcgtaccgcccgcgcagatcagccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcattttttggaggaaaaaataaaaaaagtctagactctcacgctcgcttggtcctgtgactattttgtagaaaaaagatggaagacatcaactttgcgtcgctggccccgcgtcacggctcgcgcccgttcatgggagactggacagatatcggcaccagcaatatgagcggtggcgccttcagctggggcagtctgtggagcggccttaaaaattttggttccaccattaagaactatggcaacaaagcgtggaacagcagcacgggccagatgctgagagacaagttgaaagagcagaacttccaggagaaggtggcgcagggcctggcctctggcatcagcggggtggtggacatagctaaccaggccgtgcagaaaaagataaacagtcatctggacccccgtcctcaggtggaggaaatgcctccagcgatggagacggtgtctcccgagggcaaaggcgaaaagcgcccgcggcccgacagagaagagaccctggtgtcacacaccgaggagccgccctcttacgaggaggcagtcaaggccggcctgcccaccactcgccccatagcccccatggccaccggtgtggtgggccacaggcaacacactcccgcaacactagatctgcccccgccgtccgagccgccgcgccagccaaaggcggcgacggtgcccgctccctccacttccgccgccaacagagtgcccctgcgccgcgccgcgagcggcccccgggcctcgcgagttagcggcaactggcagagcacactgaacagcatcgtgggcctgggagtgaggagtgtgaagcgccgccgttgctactgaatgagcaagctagctaacgtgttgtatgtgtgtatgcgtcctatgtcgccgccagaggagctgttgagccgccggcgccgtctgcactccagcgaatttcaagatggcgaccccatcgatgatgcctcagtggtcgtacatgcacatctcgggccaggacgcttcggagtacctgagccccgggctggtgcagttcgcccgcgccacagacacctacttcaacatgagtaacaagttcaggaaccccactgtggcgcccacccacgatgtgaccacggaccggtcgcagcgcctgacgctgcggttcatccccgtggatcgggaggacaccgcctactcttacaaggcgcggttcacgctggccgtgggcgacaaccgcgtgctggacatggcctccacttactttgacatcaggggggtgctggacaggggccccaccttcaagccctactcgggtactgcctacaactccctggcccccaagggcgctcccaattcttgcgagtgggaacaagaggaaaatcaggtggtcgctgcagatgatgaacttgaagatgaagaagcgcaagctcaagaggacgccccagctaaaaaaattcatgtatatgcccaggcgcctcttgctggcgaaaagattaccaaggatggtttgcaaataggtactgaagttgtaggagatacatctaaggacacttttgcagacaaaacattccaacccgaacctcagataggcgagtctcagtggaacgaggctgatgccacagtagcaggaggcagagtcttgaaaaaaaccacccctatgagaccttgctatggatcctatgccaggcctacaaatgccaacgggggtcaaggaattatggttgccaatgaacaaggagtgttggagtctaaagtggagatgcaatttttttctaacactacaacccttaatgcgcgggatggagctggcaatcccgaaccaaaggtggtgttgtacagtgaagatgtccacttggaatctcctgacactcatttgtcttacaagcccaaaaaggatgatgttaatgctaaaattatgttgggtcagcaagctatggctaacaggcccaacctcattgcttttagagataatttcattggactcatgtactacaacagcactggtaacatgggagtgctggcgggtcaggcctctcagttgaatgccgtggtggacctgcaggatagaaacacagaactgtcatatcagcttatgcttgattccattggggatagatccagatacttctccatgtggaaccaggcagtggatagctatgacccagatgtcagaatcattgaaaaccatggtgtcgaggacgagctacccaactactgcttccctctgggcggcataggaattactgatacttatcaagggatcaaaaataccaatggcaatggtcagtggaccaaagatgatcagttcgcggaccgtaatgaaataggggtgggaaacaacttcgccatggagatcaacatccaggccaacctctggaggaacttcctctatgcgaacgtggggctctacctgccagacaagctcaagtacaaccccaccaacgtggacatctctgacaaccccaacacctatgactacatgaacaagcgtgtggtggctcccggcctggtggactgctttgtcaatgtgggagccaggtggtccctggactacatggacaacgtcaaccccttcaaccaccaccgcaatgcgggtctgcgctaccgctccatgatcctgggcaacgggcgctacgtgcccttccacattcaggtgccccagaagttctttgccatcaagaacctcctcctcctgccgggctcctacacttacgagtggaacttcaggaaggatgtcaacatggtcctgcagagctctctgggcaatgaccttagggtggacggggccagcatcaagtttgacagcgtcaccctctatgctaccttcttccccatggctcacaacaccgcctccacgctcgaggccatgctgaggaacgacaccaacgaccagtccttcaatgactacctctctggggccaacatgctctaccccatccccgccaaggccaccaacgtgcccatctccattccctctcgcaactgggccgccttcagaggctgggcctttacccgccttaagaccaaggaaaccccctccctgggctcgggttttgacccctactttgtctactcgggatccatcccctacctggatggcaccttctacctcaaccacacttttaagaagatatccatcatgtatgactcctccgtcagctggccgggcaatgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccattggcatcactcaccagcacaacaactcgggattcgtgggctacctggctcccaccatgcgcgaggggcaggcctaccccgccaacttcccctacccgttgataggcaagaccgcggtcgacagcgtcacccagaaaaagttcctctgcgaccgcaccctctggcgcatccccttctctagcaacttcatgtccatgggtgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacctgctacctcttcgacccctttggcttctccgatcagcgcctcagacagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcacatccggggggccacctctttctgccacttgcaacaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggctcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattacgcacgctggccagcaggctctcgtcgctgatcatgtcgctgtccagatcctccgcgttgctcagggcgaatggggtcatcttgcagacctgcctgcccaggaaaggcggcagcccgggcttgccgttgcagtcgcagcgcaggggcatcagcaggtgcccgtggcccgtctgcgcctgcgggtacagcgcgcgcatgaaggcttcgatctgcctgaaagccacctgcgtcttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtcccgtgcagacacttcaggtcgccctccgtctgggtgcagcggtgctcccacagcgcgcaaccggtgggctcccaatttttgtgggtcacccccgcgtaggcctgcaggtaggcctgcaagaagcgccccatcatggccacaaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagctccgcctgctcttcttcgtcttcgctgtctaccactatctctggggaagggcttctccgctctgcggcggtgcgcttcttttttttcttgggagcagccgtgacggagtccgccacggcgacggaggtcgagggcgtggggctgggggtgcgcggtaccagggcctcgtcgccctcggactcttcctctgactccaggcggcggcggagacgcttctttgggggcgcgcgcgtcagcggcggcggagacggggacggggacggggacgggacgccctccacagggggtggtcttcgcgcagacccgcggccgcgctcgggggtcttttcgagctggtcttggtcccgactggccattgtatcctcctcctcctaggcagagagacataaggagtctatcatgcaagtcgagaaggaggagagcttaaccaccccctctgagaccgccgatgcgcccgccgtcgccgtcgcccccgctgccgccgacgcgcccgccacaccgagcgacacccccgcggaccccccagccgacgcacccctgttcgaggaagcggccgtggagcaggacccgggctttgtctcggcagaggaggatttgcgagaggaggaggataaggagaagaagccctcagtgccaaaagatgataaagagcaagacgagcacgacgcagatgcacaccagggtgaagtcgggcggggggacggagggcatgacggcgccgactacctagacgaagggaacgacgtgctcttgaagcacctgcatcgtcagtgcgccatcgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgcctttgtggtgcccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtgccaaagatcttcgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctcaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgcggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgcctggaggagcgcaacctcaaggagctggagaagctcctgcagcgcgcgctcaaagacctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaagaccaatcccgcccgcccaaggcggagctgaccgcctgcgtcatcacccagggcgagatcctaggccaattgcaagccatccaaaaagcccgccaagattttttgctgagaaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgagaaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcaattaccaccacgccccgcaataatcccaaccccagggagtggcccgcgtccctggtgtatcaggaaattcccggccccaccaccgtactacttccgcgtgattcccaggccgaagtccaaatgactaactcaggggcgcagctcgcgggcggctgtcgtcacagggtgcggcctcctcgccagggtataactcacctggagatccgaggcagaggtattcagctcaacgacgagtcggtgagctcctcgctcggtctaagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctcgggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgaggaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgactttatagagccccagtgtaacgtgacttttaaagcccatgcacagcgttgtcatactataatcaaatgtgccaccgaacacgatgaataccttatccagtataaagataaatcacacaaagtggcacttgttgacatctggaaacccgaagaccctttggaatacaatgtgaccgttttccagggtgacctcttcaaaatttacaattacactttcccatttgaccagatgtgtgactttgtcatgtacatggaaaagcagcacaagctgtggcctccgactccccagggctgtgtggaaaatccaggctctttctgcatgatctctctctgtgtaactgtgctggcactaatactcacgcttttgtatatcagatttaaatcaaggcaaagcttcatcgatgaaaagaaaatgccttaaacgctttcacgcttgattgctaacaccgggtttttatccgcagaatgattggaatcaccctactaatcacctccctccttgcgattgcccatgggttggaacgaatcgaagcccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatctaaccttgattgatgttcaaatgctggatgcgggctactattatgggcagctgggtacaatgattaattactggagaccccacaaagattacatgctccacgtagtaaagggtccccttagcagcccacccactaccacctctactacccccactaccaccactactcccaccaccagcactgccgcccagcctcctcatagcagaacaaccacttttatcaattccaagtcccactccccccacattgccggcgggccctccgcctcagactccgagaccaccgagatctgcttctgcaaatgctctgacgcctttgctgaggatttggaagaccacgaggaagatgagcatgacttcgcagatgcatgccaggcatcagaggcagaagcgctgccggtggccctcaaacagtatgcagacccccacaccacccccaaccttcctccaccttcccagaagccaagtttcctgggggaaaatgaaactctgcctctctccatactcgctctgacatctgttgctatgttgaccgctctgctggtgcttctatgctctatatgctacctgatctgctgcagaaagaaaaaatctcacggccatgctcaccagcccctcatgcacttcccttaccctccagagctgggcgaccacaaactttaagtctgcagtaactatctgcccatcccttgtcagtcgacagcgatgagccccactaatctaacggcctctggacttacaacatcgtctcttaatgagaccaccgctcctcaagacctgtacgatggtgtctccgcgctggttaaccagtgggatcacctgggcatatggtggctcctcataggagcagtgaccctgtgcctaatcctggtctggatcatctgctgcatcaaaagcagaagacccaggcggcggcccatctacaggccctttgtcatcacacctgaagatgatgatgacaccacttccaggctgcagaggctaaagcagctactcttctcttttacagcatggtaaattgaatcatgcctcgcattttcatctacttgtctctccttccactttttctgggctcttctacattggccgctgtgtcccacatcgaggtagactgcctcacgcccttcacagtctacctgcttttcggctttgtcatctgcacctttgtctgcagcgttatcactgtagtgatctgcttcatacagtgcatcgactacgtctgcgtgcgggtggcttactttagacaccacccccagtatcgcaacagggacatagcggctctcctaagacttgtttaaaatcatggccaaattaactgtgattggtcttctgatcatctgctgcgtcctagccgcgattgggactcaagctcctaccaccaccagcgctcccagaaagagacatgtatcctgcagcttcaagcgtccctggaatataccccaatgctttactgatgaacctgaaatctctttggcttggtacttcagcgtcaccgcccttcttatcttctgcagtacggttattgcccttgccatctacccttcccttgacctgggctggaatgctgtcaactctatggaatatcccaccttcccagaaccagacctgccagacctggttgttctaaacgcgtttcctcctcctgctcccgttcaaaatcagtttcgccctccgtcccccacgcccactgaggtcagctactttaatctaacaggcggagatgactgaaaacctagacctagaaatggacggtctctgcagcgagcaacgcacactagagaggcgccggcaaaaagagctcgagcgtcttaaacaagagctccaagacgcggtggccatacaccagtgcaaaaaaggtgtcttctgtctggtaaaacaggccacgctcacctatgaaaaaacaggtgacacccaccgcctaggatacaagctgcccacacagcgccagaagttcgccctcatgataggcgaacaacccatcaccgtgacccagcactccgtggagacagaaggctgcatacacgctccctgtaggggcgctgactgcctctacaccttgatcaaaaccctctgcggtctcagagacctcatcccttttaattaatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtccctttccttacccctccctttgtgtcatccgcaggaatgcaagaaaatccagctggggtgctgtccctgcacttgtcagagccccttaccacccacaatggggccctgactctaaaaatggggggcggcctgaccctggacaaggaagggaatctcacttcccaaaacatcaccagtgtcgatccccctctcaaaaaaagcaagaacaacatcagccttcagaccgccgcacccctcgccgtcagctccggggccctaacactttttgccactccccccctagcggtcagtggtgacaaccttactgtgcagtctcaggcccctctcactttggaagactcaaaactaactctggccaccaaaggacccctaactgtgtccgaaggcaaacttgtcctagaaacagaggctcccctgcatgcaagtgacagcagcagcctgggccttagcgttacggccccacttagcattaacaatgacagcctaggactagacatgcaagcgcccattagctctcgagatggaaaactggctctaacagtggcggcccccctaactgtggtcgagggtatcaatgctttggcagtagccacaggtaagggtattgggctaaatgaaaccaacacacacctgcaggcaaaactggtcgcacccctaggctttgataccaacggcaacattaagctaagcgttgcaggaggcatgaggctaaacaataacacactgatactagatgtaaactacccatttgaggctcaaggccaactgagcctaagagtgggctcgggcccactatatgtagattctagtagtcataacctaaccattagatgccttaggggattgtatataacatcttctaacaaccaaaacggtctagaagccaacattaaactaacaagaggccttgtgtatgacggaaatgccatagcagttaatgttggcaaagggctggaatacagccctactgacacaacagaaaaacctatacagactaaaataggtctaggcatggagtatgataccgagggagccatgatgacaaaactaggctctggactaagctttgacaattcaggagccattgtagtgggaaacaaaaatgatgacaggcttactttgtggaccacaccggacccatcgcccaactgtcagatctactctgaaaaagatgctaaactaaccttggtactgactaaatgtggcagtcaggttgtaggcacagtatctattgccgctcttaaaggtagcctcgtgccaatcactagtgcaatcagtgtggttcaggtatacctaaggtttgatgaaaatggggtactaatgagtaactcttcacttaatggcgaatactggaattttagaaacggagactcaactaatggcacaccatatacaaacgcagtgggtttcatgcctaatctactggcctatcctaaaggtcaaactacaactgcaaaaagtaacattgtcagccaggtctacatgaatggggacgatactaaacccatgacatttacaatcaacttcaatggccttagtgaaacaggggatacccctgttagtaaatattccatgacattctcatggaggtggccaaatggaagctacatagggcacaattttgtaacaaactcctttaccttctcctacatcgcccaagaataaagaaagcacagagatgcttgtttttgatttcaaaattgtgtgcttttatttattttcagcttacagtatttccagtagtcattcaaataaagcttaatcaaactgcatgagaacccttccacatagcttaaattagcaccagtgcaaatggagaaaaatcaacatacctttttttatccagatatcagagaactctagtggtcagttttcccccaccctcccagctcacagaatacacagtcctttccccccggctggctttaaacaacactatctcattggtaacagacatattcttaggtgtaataatccacacggtctcttggcgggccaaacgctggtcggtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgcagcaacaaggcgcgcagcaactcctgccgccgcctctccgtacggcaggaatgcaacggcgtggtggtctcctccgtgataatccgcaccgctcgcagcatcagcatcctcgtcctccgggcacagcagcgcatcctgatctcactgagatcggcgcagtaagtgcagcacaaaaccaagatgttatttaagatcccacagtgcaaagcactgtacccaaagctcatggcgggaaggacagcccccacgtgaccatcataccagatcctcaggtaaatcaaatgacgacctctcataaacacgctggacatgtacatcacctccttgggcatgtgctgattcaccacctctcgataccacaagcatcgctgattaattaaagacccctcgagcaccatcctaaaccaggaagccagcacctgaccccccgccaggcactgcagggaccccggtgaatcgcagtggcagtgaagactccagcgctcgtagccgtgaaccatagagctggtcattatatccacattggcacaacacagacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgttcggtgtagtagttgtaatacagccactccctgagaccgtcaaggcgctccctggcgtccggatctatgacaacaccgtcctgcagcgccgccctgatgacatccaccaccgtagagtatgccaagcccagccaggaaatgcattcactttgacagcgagagataggaggagcggggagagatggaagaaccatgatagtaaagagaacttttattccaatcgatcttctaagatatcaaagtggagatctataagatgacactggtctcctccgctgagtcgatcaaaaataacagctaaaccacaaacaacacgattggtcaaatgctccacaagggcctgcagcataaaattgcctcggaactccaccgcaagcataacatcaaagccaccgcctctatcgtgatcaagaataaaaaccccacagctatccaccagacccatatagttttcatctctccatcgtgaaaaaagatttacaagctcctcctttaaatcacctccaaccaattgaaaaagttgaaccagaccgccctccaccttcattttcagcaagcgtatcatgattgcaaaaattcaggctcctcagacacctgtataagattgagaagcggaacgttaacatcgatgtttcgctcgcgtaaatcacgcctcagtgcaagcataatataatcccacaggtcggagcggatcagcgaggacacctccccgccaggaaccaactcaacggagcctatgctgattataatacgcatattcggagctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacaaccacagaaaaatgcacaatttttctctcaaacatgactgcgagccctgcaaaaaataaaaaagaaacattacacaagagtagcctgtcttacgatgggatagactactctaaccaacataagacgggccacaacatcgcccgcgtggccataaaaaaaattgtccgtgtgattaaaaagaagcacagatagctggccagtcatatccggagtcatcacgtgtgaacccgtgtagacccccgggttggacacatcggccaaagaaagaaagcggccaatgtacccaggaggaattataacactaagacgaagatacaacagaataaccccatgagggggaataacaaagttagtaggtgaataaaaacgataaacacccgaaactccctcctgcgtaggcaaaatagcaccctccccttccaaaacaacatatagcgcttccacagcagccatgacaaaagactcaaaacactcaaaagactcagtcttaccaggaaaataaaagcactctcacagcaccagcactaatcagagtgtgaagagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccgctttctcacggtacgtcacttccgcaagaaaagcaaaactacatttcccacatgtgtaaaaacgaaaccccgccccttgtaaccgcccacaacttacatcatcaaaacgtaaactcctacgtcacccgccccgcctctccccgcccacctcattatcatattggccacaatccaaaataaggtatattattgatgatg

SEQ ID NO: 27 - DNA, 37195 bp, Gorilla beringei graueri
ataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagtgcgtaatatttaccgagggccgagggactttgaccgattacgtggaggactcgcccaggtgttttttacgtgaatttccgcgttccgggtcaaagtctccgttttattgtcaccgtcatttgacgcggagggtatttaaacccgctgcgctcctcaagaggccactcttgagtgccagcgagaagagttttctcctctgctccgcttcggtgatcgaaaaatgagacacatagcctgcactccgggtcttttgtccggtcgggcggcggccgagcttttggacgctttgatcaatgatgtcctgagcgatgattttccgtctactacccactttagcccacctactcttcacgaactgtacgatctggatgtactggtggatgtgaacgatcccaacgaggaggcggtttctgcgttttttcccgagtctgcgctgttggccgctcaggagggatttgacctacacactccgccgcctattttagagtctccgctgccggagcccagtggtataccttatatgcctgaactgcttcccgaagtggtagacctgacctgccacgagcctggctttccgcccagcgacgatgatggtgagccttttgttttagactttgctgagatacctgggcacggttgcaggtcttgtgcatatcatcagagggttaccggagaccccgaggttaagtgttcgctgtgctatatgaggatgacctcttcctttatctacagtaagtttttgtctaggtgggcttttgggtaggtgggttttgtgtcagaacaggtgtaaacgttgcttgtgttttttgtacctgtaggtccggtgtccgagccagacccggagcccgaccgcgatcccgagccggatcccgagcctcctcgtagggcaagaaaattaccttctattctgtgcaagtctaagacacctgtgaggaccagcgaggcggacagcaccgactctggcacttctacctctcctcctgaaattcacccagtggttcctctgggtatacatagacctgttgctgttagagtttgcgggcgacgctctgcagtagagtgcattgaggacttgcttcacgaacccgaggaacctttggacttgagcgttaaacgccctaggcaataaaccccacctaagtaataaaccccacctaagtaataaaccctgccgcccttggttattgagatgacgcccaatgtttgcttttgaatgacttcatgtgtgtaataaaagtgagtgtgatcataggtctcttgtttgtctgggcggggcttaagggtatataagtctcttggggctaaacttggttacacttgaccccaatggaggcgtgggggtgcttggaggagtttgcggacgtgcgccgtttgctggacgagagctctagcaatacctatactatttggaggtatctgtggggctctactcaggccaagttggtctccagaattaagcaggattacaagtgcgattttgaagagctttttagttcctgcggtgagcttttgcaatccttgaatctgggccatcaggctattttccaggaaaaggttctctcgactttggatttttccactcccgggcgcaccgccgcttgtgtggcttttgtgtcttttgtgcaagataaatggagcgaggagacccacctgagtcacggctacgtactggatttcatggcgatggctctttggagggcttacaacaaatggaagattcagaaggaactgtacggttccgccctacgtcgtccacttctgtcgcgacaggggctgaggtttcccgaccatcggcagcatcagaatctggaagacgagtcggaggagcgagcggaggagaagatcagcttgagagccggcctggaccctcctcaggaggaatgaatctcccgcaggtggttgacctgtttccagaactgagacgggtcctgactatcagggaggatggtcagtttgtgaagaagtttaagagggatcggggtgagggagatgatgaggcggctagcaatttagcttttagtctgatgactcgccaccgaccggaatgtattacctatcagcagattaaggagagttgtgccaacgagctggatcttttgggtcagaagtatagcatagaacagcttaccacttactggcttcagcctggggatgattgggaagaggcgatcagggtgtatgcaaaggtggccctgcggcccgattgcaagtataagattactaagttggttaatattagaaactgctgctatatttctgggaacggggccgaagtggagatagatactcaggacagggtggcttttaggtgttgcatgataaacatgtggcccgggatactggggatggatggggtggtattcatgaatgtgaggtttacgggccccaactttaatggcacggtgttcatgggcaacaccaacttgctcctgcatggtgcgagtttctatgggtttaataacacctgtatagaggcctggaccgatgtaaaggttcgaggttgttccttttatagctgttggaaggcggtggtgtgtcgccctaaaagcaggggttctgtgaaaaaatgcttgtttgaaaggtgcaccttaggcatcctctctgagggcaactccagggtgcgccataatgtggcttcgaactgcggttgcttcatgcaagtgaagggggtgagcgttatcaagcataactcggtgtgtggaaactgcgaggatcgcgcctcccagatgctgacctgctttgatggcaactgtcacctgttgaagaccattcatataagcagccaccccagaaaggcctggcccgtgtttgagcataacatcttgacccgctgctccttgcatctgggggtcaggaggggtatgttcctgccttaccagtgtaactttagccacactaaaatcctgctggaacccgagtgcatgaccaaggtcagcctgaatggtgtgtttgatgtgactctgaaaatctggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgcaccagggccgagtttgggtctagcgatgaggataccgattgaggtgggtaaggtgggcgtggctagaagggtggggcgtgtataaattgggggtctaagggtctctctgttttgtcttgcaacagccgccgccatgagcgacaccggcaacagctttgatggaagcatctttagcccctatctgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcggcgcggcctctcgcgcgtctgctcgggatgagaaactgaccgctctgctgcttaaactggaagacttgacccgggagctggctcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtacacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataggacatctttacaaatcgggggcggagggtcccggactgggggatgatggtgccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagtctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtctccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcaccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtccggaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaagcaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgttgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacaggcatgggcggcaggggcacgtcttcgccgcgcgcgggcaggggctggtgctggctccgaagagcgcttgcgtgcgcgacgacgcgacggttggtgtcctgtatctgacgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcttcctggagatctcctcgtccggcgcgctccacggtggccgccaggtcgttggagatgcgacccatgagctgcgagaaggcgttgagcccgccctcgttccagacccggctgtagaccacgcccccctcggcgttgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacaccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggttttccagcatgaggcggtggtatccgtagatgtacctggacatccaggtgatgccggcggcggtggtggtggcgcgcgcgtagtcgcggacccggttccagatgtttcgcaggggcgagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttgaatcggccggaaccgcggctaacgagggccgtggcagccccgtcctcaggaccccgccagccgacttctccagttacgggagcgagccccttttgttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtgaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggccgatgaccaggaagaggaggactatgagctagaggagggcgagtacctggaggactgacctggctggtggtgttttggtatagatgcaagatccgaacgtggcggacccggcggtccgggcggcgctgcaaagccagccgtccggcattaactcctctgacgactgggccgcggccatgggtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggacgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttcaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggagacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacccaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcatcaaccgcctgatggactacttgcatcgggcggcggccgtgaaccccgagtacttcactaatgccattctgaatccccactggatgccccctccgggtttctacaacggggactttgaggtgcccgaggtcaacgacgggttcctctgggatgacatggatgacagtgtgttctcacccaacccgctgcgcgccgcgtctctgcgattgaaggagggctctgacagggaaggaccgagaagtctggcctcctccctggctctgggagcggtgggcgccacgggcgcggcggcgcggggcagtagccccttccccagcctggcagactctctgaacagcgggcgggtgagcaggccccgcttgctaggcgaggaggagtatctgaacaactccctgctgcagcccgcgagggacaagaacgctcagcggcagcagtttcccaacaatgggatagagagcctggtggacaagatgtccagatggaagacgtatgcgcaggagtacaaggagtgggaggaccgccagccgcggcccttgccgccccctaggcagcgctggcagcggcgcgcgtccaaccgccgctggaggcaggggcccgaggacgatgatgactctgcagatgacagcagcgtgttggacctgggcgggagcgggaaccccttttcgcacctgcgcccacgcctgggcaagatgttttaaaagaaaaaaaaaaaataaaactcaccaaggccatggcgacgagcgttggttttttgttcccttccttagtatgcggcgcgcggcgatgttcgaggaggggcctcccccctcttacgagagcgcgatggggatttctcctgcggcgcccctgcagcctccctacgtgcctcctcggtacctgcaacctacaggggggagaaatagcatctgttactctgagctgcagcccctgtacgataccaccagactgtacctggtggacaacaagtccgcggacgtggcctccctgaactaccagaacgaccacagcgattttttgaccacggtgatccaaaacaacgacttcaccccaaccgaggccagcactcagaccataaacctggataacaggtcgaactggggcggcgacctgaagaccatcttgcacaccaacatgcccaacgtgaacgagttcatgttcaccaactcttttaaggcgcgggtgatggtggcgcgcgagcagggggaggcgaagtacgagtgggtggacttcacgctgcccgagggcaactactcagagaccatgactctcgacctgatgaacaatgcgatcgtggaacactatctgaaagtgggcaggcagaacggggtgaaggaaagcgatatcggggtcaagtttgacaccagaaacttccgtctgggctgggaccccgtgaccgggctggtcatgccgggggtctacaccaacgaggcctttcatcccgacatagtgcttctgcccggctgtggggtggacttcacccagagccggctgagcaacctgctgggcattcgcaagcggcagcctttccaggagggtttcaagatcacctatgaggatctgaaggggggcaacattcccgcgctccttgatctggacgcctacgaggagagcttgaaacccgaggagagcgctggcgacagcggcgagagtggcgaggagcaagccggcggcggtggcggcgcgtcggtagaaaacgaaagtacgcccgcagtggcggcggacgctgcggaggtcgagccggaggccatgcagcaggacgcagaggagggcgcacaggagggcgcgcagaaggacatgaacgatggggagatcaggggagacacattcgccacccggggcgaagaaaaagaggcagaggcggcggcggcggcgacggcggaggccgaaaccgaggttgaggcagaggcagagcccgagaccgaagttatggaagacatgaatgatggagaacgtaggggcgacacgttcgccacccggggcgaagagaaggcggcggaggcagaagccgcggctgaggaggcggctgcggctgcggccaagactgaggctgcggctaaggctgaggtcgaagccaatgttgcggttgaggctcaggctgaggaggaggcggcggctgaagcagttaaggaaaaggcccaggcagagcaggaagagaaaaaacctgtcattcaacctctaaaagaagatagcaaaaagcgcagttacaacgtcatcgagggcagcacctttacccagtaccgcagctggtacctggcgtacaactacggcgacccggtcaagggggtgcgctcgtggaccctgctctgcacgccggacgtcacctgcggctccgagcagatgtactggtcgctgccgaacatgatgcaagacccggtgaccttccgctccacgcggcaggttagcaacttcccggtggtgggcgccgaactgctgcccgtgcactccaagagtttttacaacgagcaggccgtctactcccagctgatccgccaggccacctctctgacccacgtgttcaatcgctttcccgagaaccagattttggcgcgcccgccggcccccaccatcaccaccgtgagtgaaaacgttcctgccctcacagatcacgggacgctaccgctgcgcaacagcatctcaggagtccagcgagtgaccattactgacgccagacgccggacctgcccctacgtttacaaggccttgggcatagtctcgccgcgcgtcctctccagtcgcactttttaaaacacatctacccacacgttccaaaatcatgtccgtactcatctcacccagcaacaacaccggctgggggctgcgcgcgcccagcaagatgtttggaggggcgaggaagcgctccgaccagcaccctgtgcgcgtgcgcggccactaccgcgcgccctggggagcgcacaagcgcgggcgcacagggcgcaccactgtggacgacgtcattgactccgtagtggagcaagcgcgccactacacacccggcgcgccgaccgcccccgccgtgtccaccgtggaccaggcgatcgaaagcgtggtacagggcgcgcggcactatgccaaccttaaaagtcgccgccgccgcgtggcccgccgccatcgccggagaccccgggccaccgccgccgcgcgccttactaaggctctgctcaggcgcgccaggcgaactggccaccgggccgccatgagggccgcacggcgggctgccgctgccgcaagcgccgtggccccgcgggcacgaaggcgcgcggccgccgccgccgccgccgccatttccagcttggcctcgacgcggcgcggtaacatatactgggtgcgcgactcggtaaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgatgacgaggcggtggagtttgtccgccgcatggcacccaggcgccccgtgcagtggaagggccggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtaaccctgcaacaggtgctgcctttgagcgcgcccagcgagcataagcgagggttgaagcgcgaaggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcggcggccagcgccaccaccggcaccgcttcggtagaggtgcagacggacccctggctacccgccaccgctgttgccgccgccgccccccgttcgcgcgggcgcaagagaaattatccagcggccagcgcgctcatgccccagtacgcactgcatccatccatcgcgcccacccccggctaccgcgggtactcgtaccgcccgcgcagatcagccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcattttttggaggaaaaataaaaaaagtctagactctcacgctcgcttggtcctgtgactattttgtagaaaaaagatggaagacatcaactttgcgtcgctggccccgcgtcacggctcgcgcccgttcatgggagactggacagatatcggcaccagcaatatgagcggtggcgccttcagctggggcagtctgtggagcggccttaaaaattttggttccaccattaagaactatggcaacaaagcgtggaacagcagcacgggccagatgctgagagacaagttgaaagagcagaacttccaggagaaggtggcgcagggcctggcctctggcatcagcggggtggtggacatagctaaccaggccgtgcagaaaaagataaacagtcatctggacccccgtcctcaggtggaggaaatgcctccagcgatggagacggtgtctcccgagggcaaaggcgaaaagcgcccgcggcccgacagagaagagaccctggtgtcacacaccgaggagccgccctcttacgaggaggcagtcaaggccggcctgcccaccactcgccccatagcccccatggccaccggtgtggtgggccacaggcaacacactcccgcaacactagatctgcccccgccgtccgagccgccgcgccagccaaaggcggcgacggtgcccgctccctccacttccgccgccaacagagtgcccctgcgccgcgccgcgagcggcccccgggcctcgcgagttagcggcaactggcagagcacactgaacagcatcgtgggcctgggagtgaggagtgtgaagcgccgccgttgctactgaatgagcaagctagctaacgtgttgtatgtgtgtatgcgtcctatgtcgccgccagaggagctgttgagccgccggcgccgtctgcactccagcgaatttcaagatggcgaccccatcgatgatgcctcagtggtcgtacatgcacatctcgggccaggacgcttcggagtacctgagccccgggctggtgcagttcgcccgcgccacagacacctacttcaacatgagtaacaagttcaggaaccccactgtggcgcccacccacgatgtgaccacggaccggtcgcagcgcctgacgctgcggttcatccccgtggatcgggaggacaccgcctactcttacaaggcgcggttcacgctggccgtgggcgacaaccgcgtgctggacatggcctccacttactttgacatcaggggggtgctggacaggggccccaccttcaagccctactcgggtactgcctacaactccctggcccccaagggcgctcccaattcttgcgagtgggaacaagaggaaaatcaggtggtcgctgcagatgatgaacttgaagatgaagaagcgcaagctcaagaggacgccccagctaaaaaaattcatgtatatgcccaggcgcctcttgctggcgaaaagattaccaaggatggtttgcaaataggtactgaagttgtaggagatacatctaaggacacttttgcagacaaaacattccaacccgaacctcagataggcgagtctcagtggaacgaggctgatgccacagtagcaggaggcagagtcttgaaaaaaaccacccctatgagaccttgctatggatcctatgccaggcctacaaatgccaacgggggtcaaggaattatggttgccaatgaacaaggagtgttggagtctaaagtggagatgcaatttttttctaacactacaacccttaatgcgcgggatggagctggcaatcccgaaccaaaggtggtgttgtacagtgaagatgtccacttggaatctcctgacactcatttgtcttacaagcccaaaaaggatgatgttaatgctaaaattatgttgggtcagcaagctatggctaacaggcccaacctcattgcttttagagataatttcattggactcatgtactacaacagcactggtaacatgggagtgctggcgggtcaggcctctcagttgaatgccgtggtggacctgcaggatagaaacacagaactgtcatatcagcttatgcttgattccattggggatagatccagatacttctccatgtggaaccaggcagtggatagctatgacccagatgtcagaatcattgaaaaccatggtgtcgaggacgagctacccaactactgcttccctctgggcggcataggaattactgatacttatcaagggatcaaaaataccaatggcaatggtcagtggaccaaagatgatcagttcgcggaccgtaatgaaataggggtgggaaacaacttcgccatggagatcaacatccaggccaacctctggaggaacttcctctatgcgaacgtggggctctacctgccagacaagctcaagtacaaccccaccaacgtggacatctctgacaaccccaacacctatgactacatgaacaagcgtgtggtggctcccggcctggtggactgctttgtcaatgtgggagccaggtggtccctggactacatggacaacgtcaaccccttcaaccaccaccgcaatgcgggtctgcgctaccgctccatgatcctgggcaacgggcgctacgtgcccttccacattcaggtgccccagaagttctttgccatcaagaacctcctcctcctgccgggctcctacacttacgagtggaacttcaggaaggatgtcaacatggtcctgcagagctctctgggcaatgaccttagggtggacggggccagcatcaagtttgacagcgtcaccctctatgctaccttcttccccatggctcacaacaccgcctccacgctcgaggccatgctgaggaacgacaccaacgaccagtccttcaatgactacctctctggggccaacatgctctaccccatccccgccaaggccaccaacgtgcccatctccattccctctcgcaactgggccgccttcagaggctgggcctttacccgccttaagaccaaggaaaccccctccctgggctcgggttttgacccctactttgtctactcgggatccatcccctacctggatggcaccttctacctcaaccacacttttaagaagatatccatcatgtatgactcctccgtcagctggccgggcaatgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccattggcatcactcaccagcacaacaactcgggattcgtgggctacctggctcccaccatgcgcgaggggcaggcctaccccgccaacttcccctacccgttgataggcaagaccgcggtcgacagcgtcacccagaaaaagttcctctgcgaccgcaccctctggcgcatccccttctctagcaacttcatgtccatgggtgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacctgctacctcttcgacccctttggcttctccgatcagcgcctcagacagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcacatccggggggccacctctttctgccacttgcaacaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggctcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattacgcacgctggccagcaggctctcgtcgctgatcatgtcgctgtccagatcctccgcgttgctcagggcgaatggggtcatcttgcagacctgcctgcccaggaaaggcggcagcccgggcttgccgttgcagtcgcagcgcaggggcatcagcaggtgcccgtggcccgtctgcgcctgcgggtacagcgcgcgcatgaaggcttcgatctgcctgaaagccacctgcgtcttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtcccgtgcagacacttcaggtcgccctccgtctgggtgcagcggtgctcccacagcgcgcaaccggtgggctcccaatttttgtgggtcacccccgcgtaggcctgcaggtaggcctgcaagaagcgccccatcatggccacaaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagctccgcctgctcttcttcgtcttcgctgtctaccactatctctggggaagggcttctccgctctgcggcggtgcgcttcttttttttcttgggagcagccgtgacggagtccgccacggcgacggaggtcgagggcgtggggctgggggtgcgcggtaccagggcctcgtcgccctcggactcttcctctgactccaggcggcggcggagacgcttctttgggggcgcgcgcgtcagcggcggcggagacggggacggggacggggacgggacgccctccacagggggtggtcttcgcgcagacccgcggccgcgctcgggggtcttttcgagctggtcttggtcccgactggccattgtatcctcctcctcctaggcagagagacataaggagtctatcatgcaagtcgagaaggaggagagcttaaccaccccctctgagaccgccgatgcgcccgccgtcgccgtcgcccccgctgccgccgacgcgcccgccacaccgagcgacacccccgcggaccccccagccgacgcacccctgttcgaggaagcggccgtggagcaggacccgggctttgtctcggcagaggaggatttgcgagaggaggaggataaggagaagaagccctcagtgccaaaagatgataaagagcaagacgagcacgacgcagatgcacaccagggtgaagtcgggcggggggacggagggcatgacggcgccgactacctagacgaagggaacgacgtgctcttgaagcacctgcatcgtcagtgcgccatcgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgcctttgtggtgcccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtgccaaagatcttcgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctcaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgcggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgcctggaggagcgcaacctcaaggagctggagaagctcctgcagcgcgcgctcaaagacctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaagaccaatcccgcccgcccaaggcggagctgaccgcctgcgtcatcacccagggcgagatcctaggccaattgcaagccatccaaaaagcccgccaagattttttgctgagaaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgagaaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcaattaccaccacgccccgcaataatcccaaccccagggagtggcccgcgtccctggtgtatcaggaaattcccggccccaccaccgtactacttccgcgtgattcccaggccgaagtccaaatgactaactcaggggcgcagctcgcgggcggctgtcgtcacagggtgcggcctcctcgccagggtataactcacctggagatccgaggcagaggtattcagctcaacgacgagtcggtgagctcctcgctcggtctaagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctcgggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgaggaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgactttatagagccccagtgtaacgtgacttttaaagcccatgcacagcgttgtcatactataatcaaatgtgccaccgaacacgatgaataccttatccagtataaagataaatcacacaaagtggcacttgttgacatctggaaacccgaagaccctttggaatacaatgtgaccgttttccagggtgacctcttcaaaatttacaattacactttcccatttgaccagatgtgtgactttgtcatgtacatggaaaagcagcacaagctgtggcctccgactccccagggctgtgtggaaaatccaggctctttctgcatgatctctctctgtgtaactgtgctggcactaatactcacgcttttgtatatcagatttaaatcaaggcaaagcttcatcgatgaaaagaaaatgccttaaacgctttcacgcttgattgctaacaccgggtttttatccgcagaatgattggaatcaccctactaatcacctccctccttgcgattgcccatgggttggaacgaatcgaagcccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatctaaccttgattgatgttcaaatgctggatgcgggctactattatgggcagctgggtacaatgattaattactggagaccccacaaagattacatgctccacgtagtaaagggtccccttagcagcccacccactaccacctctactacccccactaccaccactactcccaccaccagcactgccgcccagcctcctcatagcagaacaaccacttttatcaattccaagtcccactccccccacattgccggcgggccctccgcctcagactccgagaccaccgagatctgcttctgcaaatgctctgacgcctttgctgaggatttggaagaccacgaggaagatgagcatgacttcgcagatgcatgccaggcatcagaggcagaagcgctgccggtggccctcaaacagtatgcagacccccacaccacccccaaccttcctccaccttcccagaagccaagtttcctgggggaaaatgaaactctgcctctctccatactcgctctgacatctgttgctatgttgaccgctctgctggtgcttctatgctctatatgctacctgatctgctgcagaaagaaaaaatctcacggccatgctcaccagcccctcatgcacttcccttaccctccagagctgggcgaccacaaactttaagtctgcagtaactatctgcccatcccttgtcagtcgacagcgatgagccccactaatctaacggcctctggacttacaacatcgtctcttaatgagaccaccgctcctcaagacctgtacgatggtgtctccgcgctggttaaccagtgggatcacctgggcatatggtggctcctcataggagcagtgaccctgtgcctaatcctggtctggatcatctgctgcatcaaaagcagaagacccaggcggcggcccatctacaggccctttgtcatcacacctgaagatgatgatgacaccacttccaggctgcagaggctaaagcagctactcttctcttttacagcatggtaaattgaatcatgcctcgcattttcatctacttgtctctccttccactttttctgggctcttctacattggccgctgtgtcccacatcgaggtagactgcctcacgcccttcacagtctacctgcttttcggctttgtcatctgcacctttgtctgcagcgttatcactgtagtgatctgcttcatacagtgcatcgactacgtctgcgtgcgggtggcttactttagacaccacccccagtatcgcaacagggacatagcggctctcctaagacttgtttaaaatcatggccaaattaactgtgattggtcttctgatcatctgctgcgtcctagccgcgattgggactcaagctcctaccaccaccagcgctcccagaaagagacatgtatcctgcagcttcaagcgtccctggaatataccccaatgctttactgatgaacctgaaatctctttggcttggtacttcagcgtcaccgcccttcttatcttctgcagtacggttattgcccttgccatctacccttcccttgacctgggctggaatgctgtcaactctatggaatatcccaccttcccagaaccagacctgccagacctggttgttctaaacgcgtttcctcctcctgctcccgttcaaaatcagtttcgccctccgtcccccacgcccactgaggtcagctactttaatctaacaggcggagatgactgaaaacctagacctagaaatggacggtctctgcagcgagcaacgcacactagagaggcgccggcaaaaagagctcgagcgtcttaaacaagagctccaagacgcggtggccatacaccagtgcaaaaaaggtgtcttctgtctggtaaaacaggccacgctcacctatgaaaaaacaggtgacacccaccgcctaggatacaagctgcccacacagcgccagaagttcgccctcatgataggcgaacaacccatcaccgtgacccagcactccgtggagacagaaggctgcatacacgctccctgtaggggcgctgactgcctctacaccttgatcaaaaccctctgcggtctcagagacctcatcccttttaattaatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtccctttccttacccctccctttgtgtcatccgcaggaatgcaagaaaatccagctggggtgctgtccctgcacttgtcagagccccttaccacccacaatggggccctgactctaaaaatggggggcggcctgaccctggacaaggaagggaatctcacttcccaaaacatcaccagtgtcgatccccctctcaaaaaaagcaagaacaacatcagccttcagaccgccgcacccctcgccgtcagctccggggccctaacactttttgccactccccccctagcggtcagtggtgacaaccttactgtgcagtctcaggcccctctcactttggaagactcaaaactaactctggccaccaaaggacccctaactgtgtccgaaggcaaacttgtcctagaaacagaggctcccctgcatgcaagtgacagcagcagcctgggccttagcgttacggccccacttagcattaacaatgacagcctaggactagacatgcaagcgcccattagctctcgagatggaaaactggctctaacagtggcggcccccctaactgtggtcgagggtatcaatgctttggcagtagccacaggtaagggtattgggctaaatgaaaccaacacacacctgcaggcaaaactggtcgcacccctaggctttgataccaacggcaacattaagctaagcgttgcaggaggcatgaggctaaacaataacacactgatactagatgtaaactacccatttgaggctcaaggccaactgagcctaagagtgggctcgggcccactatatgtagattctagtagtcataacctaaccattagatgccttaggggattgtatataacatcttctaacaaccaaaacggtctagaagccaacattaaactaacaagaggccttgtgtatgacggaaatgccatagcagttaatgttggcaaagggctggaatacagccctactgacacaacagaaaaacctatacagactaaaataggtctaggcatggagtatgataccgagggagccatgatgacaaaactaggctctggactaagctttgacaattcaggagccattgtagtgggaaacaaaaatgatgacaggcttactttgtggaccacaccggacccatcgcccaactgtcagatctactctgaaaaagatgctaaactaaccttggtactgactaaatgtggcagtcaggttgtaggcacagtatctattgccgctcttaaaggtagcctcgtgccaatcactagtgcaatcagtgtggttcaggtatacctaaggtttgatgaaaatggggtactaatgagtaactcttcacttaatggcgaatactggaattttagaaacggagactcaactaatggcacaccatatacaaacgcagtgggtttcatgcctaatctactggcctatcctaaaggtcaaactacaactgcaaaaagtaacattgtcagccaggtctacatgaatggggacgatactaaacccatgacatttacaatcaacttcaatggccttagtgaaacaggggatacccctgttagtaaatattccatgacattctcatggaggtggccaaatggaagctacatagggcacaattttgtaacaaactcctttaccttctcctacatcgcccaagaataaagaaagcacagagatgcttgtttttgatttcaaaattgtgtgcttttatttattttcagcttacagtatttccagtagtcattcaaataaagcttaatcaaactgcatgagaacccttccacatagcttaaattagcaccagtgcaaatggagaaaaatcaacatacctttttttatccagatatcagagaactctagtggtcagttttcccccaccctcccagctcacagaatacacagtcctttccccccggctggctttaaacaacactatctcattggtaacagacatattcttaggtgtaataatccacacggtctcttggcgggccaaacgctggtcggtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgcagcaacaaggcgcgcagcaactcctgccgccgcctctccgtacggcaggaatgcaacggcgtggtggtctcctccgtgataatccgcaccgctcgcagcatcagcatcctcgtcctccgggcacagcagcgcatcctgatctcactgagatcggcgcagtaagtgcagcacaaaaccaagatgttatttaagatcccacagtgcaaagcactgtacccaaagctcatggcgggaaggacagcccccacgtgaccatcataccagatcctcaggtaaatcaaatgacgacctctcataaacacgctggacatgtacatcacctccttgggcatgtgctgattcaccacctctcgataccacaagcatcgctgattaattaaagacccctcgagcaccatcctaaaccaggaagccagcacctgaccccccgccaggcactgcagggaccccggtgaatcgcagtggcagtgaagactccagcgctcgtagccgtgaaccatagagctggtcattatatccacattggcacaacacagacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgttcggtgtagtagttgtaatacagccactccctgagaccgtcaaggcgctccctggcgtccggatctatgacaacaccgtcctgcagcgccgccctgatgacatccaccaccgtagagtatgccaagcccagccaggaaatgcattcactttgacagcgagagataggaggagcggggagagatggaagaaccatgatagtaaagagaacttttattccaatcgatcttctaagatatcaaagtggagatctataagatgacactggtctcctccgctgagtcgatcaaaaataacagctaaaccacaaacaacacgattggtcaaatgctccacaagggcctgcagcataaaattgcctcggaactccaccgcaagcataacatcaaagccaccgcctctatcgtgatcaagaataaaaaccccacagctatccaccagacccatatagttttcatctctccatcgtgaaaaaagatttacaagctcctcctttaaatcacctccaaccaattgaaaaagttgaaccagaccgccctccaccttcattttcagcaagcgtatcatgattgcaaaaattcaggctcctcagacacctgtataagattgagaagcggaacgttaacatcgatgtttcgctcgcgtaaatcacgcctcagtgcaagcataatataatcccacaggtcggagcggatcagcgaggacacctccccgccaggaaccaactcaacggagcctatgctgattataatacgcatattcggagctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacaaccacagaaaaatgcacaatttttctctcaaacatgactgcgagccctgcaaaaaataaaaaagaaacattacacaagagtagcctgtcttacgatgggatagactactctaaccaacataagacgggccacaacatcgcccgcgtggccataaaaaaaattgtccgtgtgattaaaaagaagcacagatagctggccagtcatatccggagtcatcacgtgtgaacccgtgtagacccccgggttggacacatcggccaaagaaagaaagcggccaatgtacccaggaggaattataacactaagacgaagatacaacagaataaccccatgagggggaataacaaagttagtaggtgaataaaaacgataaacacccgaaactccctcctgcgtaggcaaaatagcaccctccccttccaaaacaacatatagcgcttccacagcagccatgacaaaagactcaaaacactcaaaagactcagtcttaccaggaaaataaaagcactctcacagcaccagcactaatcagagtgtgaagagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccgctttctcacggtacgtcacttccgcaagaaaagcaaaactacatttcccacatgtgtaaaaacgaaaccccgccccttgtaaccgcccacaacttacatcatcaaaacgtaaactcctacgtcacccgccccgcctctccccgcccacctcattatcatattggccacaatccaaaataaggtatattat

SEQ ID NO: 28 - DNA, 37197 bp, Gorilla beringei graueri
ataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagtgcgtaatatttaccgagggccgagggactttgaccgattacgtggaggactcgcccaggtgttttttacgtgaatttccgcgttccgggtcaaagtctccgttttattgtcaccgtcatttgacgcggagggtatttaaacccgctgcgctcctcaagaggccactcttgagtgccagcgagaagagttttctcctctgctccgcttcggtgatcgaaaaatgagacacatagcctgcactccgggtcttttgtccggtcgggcggcggccgagcttttggacgctttgatcaatgatgtcctgagcgatgattttccgtctactacccactttagcccacctactcttcacgaactgtacgatctggatgtactggtggatgtgaacgatcccaacgaggaggcggtttctgcgttttttcccgagtctgcgctgttggccgctcaggagggatttgacctacacactccgccgcctattttagagtctccgctgccggagcccagtggtataccttatatgcctgaactgcttcccgaagtggtagacctgacctgccacgagcctggctttccgcccagcgacgatgatggtgagccttttgttttagactttgctgagatacctgggcacggttgcaggtcttgtgcatatcatcagagggttaccggagaccccgaggttaagtgttcgctgtgctatatgaggatgacctcttcctttatctacagtaagtttttgtctaggtgggcttttgggtaggtgggttttgtgtcagaacaggtgtaaacgttgcttgtgttttttgtacctgtaggtccggtgtccgagccagacccggagcccgaccgcgatcccgagccggatcccgagcctcctcgtagggcaagaaaattaccttctattctgtgcaagtctaagacacctgtgaggaccagcgaggcggacagcaccgactctggcacttctacctctcctcctgaaattcacccagtggttcctctgggtatacatagacctgttgctgttagagtttgcgggcgacgctctgcagtagagtgcattgaggacttgcttcacgaacccgaggaacctttggacttgagcgttaaacgccctaggcaataaaccccacctaagtaataaaccccacctaagtaataaaccctgccgcccttggttattgagatgacgcccaatgtttgcttttgaatgacttcatgtgtgtaataaaagtgagtgtgatcataggtctcttgtttgtctgggcggggcttaagggtatataagtctcttggggctaaacttggttacacttgaccccaatggaggcgtgggggtgcttggaggagtttgcggacgtgcgccgtttgctggacgagagctctagcaatacctatactatttggaggtatctgtggggctctactcaggccaagttggtctccagaattaagcaggattacaagtgcgattttgaagagctttttagttcctgcggtgagcttttgcaatccttgaatctgggccatcaggctattttccaggaaaaggttctctcgactttggatttttccactcccgggcgcaccgccgcttgtgtggcttttgtgtcttttgtgcaagataaatggagcgaggagacccacctgagtcacggctacgtactggatttcatggcgatggctctttggagggcttacaacaaatggaagattcagaaggaactgtacggttccgccctacgtcgtccacttctgtcgcgacaggggctgaggtttcccgaccatcggcagcatcagaatctggaagacgagtcggaggagcgagcggaggagaagatcagcttgagagccggcctggaccctcctcaggaggaatgaatctcccgcaggtggttgacctgtttccagaactgagacgggtcctgactatcagggaggatggtcagtttgtgaagaagtttaagagggatcggggtgagggagatgatgaggcggctagcaatttagcttttagtctgatgactcgccaccgaccggaatgtattacctatcagcagattaaggagagttgtgccaacgagctggatcttttgggtcagaagtatagcatagaacagcttaccacttactggcttcagcctggggatgattgggaagaggcgatcagggtgtatgcaaaggtggccctgcggcccgattgcaagtataagattactaagttggttaatattagaaactgctgctatatttctgggaacggggccgaagtggagatagatactcaggacagggtggcttttaggtgttgcatgataaacatgtggcccgggatactggggatggatggggtggtattcatgaatgtgaggtttacgggccccaactttaatggcacggtgttcatgggcaacaccaacttgctcctgcatggtgcgagtttctatgggtttaataacacctgtatagaggcctggaccgatgtaaaggttcgaggttgttccttttatagctgttggaaggcggtggtgtgtcgccctaaaagcaggggttctgtgaaaaaatgcttgtttgaaaggtgcaccttaggcatcctctctgagggcaactccagggtgcgccataatgtggcttcgaactgcggttgcttcatgcaagtgaagggggtgagcgttatcaagcataactcggtgtgtggaaactgcgaggatcgcgcctcccagatgctgacctgctttgatggcaactgtcacctgttgaagaccattcatataagcagccaccccagaaaggcctggcccgtgtttgagcataacatcttgacccgctgctccttgcatctgggggtcaggaggggtatgttcctgccttaccagtgtaactttagccacactaaaatcctgctggaacccgagtgcatgaccaaggtcagcctgaatggtgtgtttgatgtgactctgaaaatctggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgcaccagggccgagtttgggtctagcgatgaggataccgattgaggtgggtaaggtgggcgtggctagaagggtggggcgtgtataaattgggggtctaagggtctctctgttttgtcttgcaacagccgccgccatgagcgacaccggcaacagctttgatggaagcatctttagcccctatctgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcggcgcggcctctcgcgcgtctgctcgggatgagaaactgaccgctctgctgcttaaactggaagacttgacccgggagctggctcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtacacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataggacatctttacaaatcgggggcggagggtcccggactgggggatgatggtgccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagtctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtctccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcaccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtccggaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaagcaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgttgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacaggcatgggcggcaggggcacgtcttcgccgcgcgcgggcaggggctggtgctggctccgaagagcgcttgcgtgcgcgacgacgcgacggttggtgtcctgtatctgacgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcttcctggagatctcctcgtccggcgcgctccacggtggccgccaggtcgttggagatgcgacccatgagctgcgagaaggcgttgagcccgccctcgttccagacccggctgtagaccacgcccccctcggcgttgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacaccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggttttccagcatgaggcggtggtatccgtagatgtacctggacatccaggtgatgccggcggcggtggtggtggcgcgcgcgtagtcgcggacccggttccagatgtttcgcaggggcgagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttgaatcggccggaaccgcggctaacgagggccgtggcagccccgtcctcaggaccccgccagccgacttctccagttacgggagcgagccccttttgttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtgaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggccgatgaccaggaagaggaggactatgagctagaggagggcgagtacctggaggactgacctggctggtggtgttttggtatagatgcaagatccgaacgtggcggacccggcggtccgggcggcgctgcaaagccagccgtccggcattaactcctctgacgactgggccgcggccatgggtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggacgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttcaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggagacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacccaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcatcaaccgcctgatggactacttgcatcgggcggcggccgtgaaccccgagtacttcactaatgccattctgaatccccactggatgccccctccgggtttctacaacggggactttgaggtgcccgaggtcaacgacgggttcctctgggatgacatggatgacagtgtgttctcacccaacccgctgcgcgccgcgtctctgcgattgaaggagggctctgacagggaaggaccgagaagtctggcctcctccctggctctgggagcggtgggcgccacgggcgcggcggcgcggggcagtagccccttccccagcctggcagactctctgaacagcgggcgggtgagcaggccccgcttgctaggcgaggaggagtatctgaacaactccctgctgcagcccgcgagggacaagaacgctcagcggcagcagtttcccaacaatgggatagagagcctggtggacaagatgtccagatggaagacgtatgcgcaggagtacaaggagtgggaggaccgccagccgcggcccttgccgccccctaggcagcgctggcagcggcgcgcgtccaaccgccgctggaggcaggggcccgaggacgatgatgactctgcagatgacagcagcgtgttggacctgggcgggagcgggaaccccttttcgcacctgcgcccacgcctgggcaagatgttttaaaagaaaaaaaaaaaaataaaactcaccaaggccatggcgacgagcgttggttttttgttcccttccttagtatgcggcgcgcggcgatgttcgaggaggggcctcccccctcttacgagagcgcgatggggatttctcctgcggcgcccctgcagcctccctacgtgcctcctcggtacctgcaacctacaggggggagaaatagcatctgttactctgagctgcagcccctgtacgataccaccagactgtacctggtggacaacaagtccgcggacgtggcctccctgaactaccagaacgaccacagcgattttttgaccacggtgatccaaaacaacgacttcaccccaaccgaggccagcactcagaccataaacctggataacaggtcgaactggggcggcgacctgaagaccatcttgcacaccaacatgcccaacgtgaacgagttcatgttcaccaactcttttaaggcgcgggtgatggtggcgcgcgagcagggggaggcgaagtacgagtgggtggacttcacgctgcccgagggcaactactcagagaccatgactctcgacctgatgaacaatgcgatcgtggaacactatctgaaagtgggcaggcagaacggggtgaaggaaagcgatatcggggtcaagtttgacaccagaaacttccgtctgggctgggaccccgtgaccgggctggtcatgccgggggtctacaccaacgaggcctttcatcccgacatagtgcttctgcccggctgtggggtggacttcacccagagccggctgagcaacctgctgggcattcgcaagcggcagcctttccaggagggtttcaagatcacctatgaggatctgaaggggggcaacattcccgcgctccttgatctggacgcctacgaggagagcttgaaacccgaggagagcgctggcgacagcggcgagagtggcgaggagcaagccggcggcggtggcggcgcgtcggtagaaaacgaaagtacgcccgcagtggcggcggacgctgcggaggtcgagccggaggccatgcagcaggacgcagaggagggcgcacaggagggcgcgcagaaggacatgaacgatggggagatcaggggagacacattcgccacccggggcgaagaaaaagaggcagaggcggcggcggcggcgacggcggaggccgaaaccgaggttgaggcagaggcagagcccgagaccgaagttatggaagacatgaatgatggagaacgtaggggcgacacgttcgccacccggggcgaagagaaggcggcggaggcagaagccgcggctgaggaggcggctgcggctgcggccaagactgaggctgcggctaaggctgaggtcgaagccaatgttgcggttgaggctcaggctgaggaggaggcggcggctgaagcagttaaggaaaaggcccaggcagagcaggaagagaaaaaacctgtcattcaacctctaaaagaagatagcaaaaagcgcagttacaacgtcatcgagggcagcacctttacccagtaccgcagctggtacctggcgtacaactacggcgacccggtcaagggggtgcgctcgtggaccctgctctgcacgccggacgtcacctgcggctccgagcagatgtactggtcgctgccgaacatgatgcaagacccggtgaccttccgctccacgcggcaggttagcaacttcccggtggtgggcgccgaactgctgcccgtgcactccaagagtttttacaacgagcaggccgtctactcccagctgatccgccaggccacctctctgacccacgtgttcaatcgctttcccgagaaccagattttggcgcgcccgccggcccccaccatcaccaccgtgagtgaaaacgttcctgccctcacagatcacgggacgctaccgctgcgcaacagcatctcaggagtccagcgagtgaccattactgacgccagacgccggacctgcccctacgtttacaaggccttgggcatagtctcgccgcgcgtcctctccagtcgcactttttaaaacacatctacccacacgttccaaaatcatgtccgtactcatctcacccagcaacaacaccggctgggggctgcgcgcgcccagcaagatgtttggaggggcgaggaagcgctccgaccagcaccctgtgcgcgtgcgcggccactaccgcgcgccctggggagcgcacaagcgcgggcgcacagggcgcaccactgtggacgacgtcattgactccgtagtggagcaagcgcgccactacacacccggcgcgccgaccgcccccgccgtgtccaccgtggaccaggcgatcgaaagcgtggtacagggcgcgcggcactatgccaaccttaaaagtcgccgccgccgcgtggcccgccgccatcgccggagaccccgggccaccgccgccgcgcgccttactaaggctctgctcaggcgcgccaggcgaactggccaccgggccgccatgagggccgcacggcgggctgccgctgccgcaagcgccgtggccccgcgggcacgaaggcgcgcggccgccgccgccgccgccgccatttccagcttggcctcgacgcggcgcggtaacatatactgggtgcgcgactcggtaaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgatgacgaggcggtggagtttgtccgccgcatggcacccaggcgccccgtgcagtggaagggccggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtaaccctgcaacaggtgctgcctttgagcgcgcccagcgagcataagcgagggttgaagcgcgaaggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcggcggccagcgccaccaccggcaccgcttcggtagaggtgcagacggacccctggctacccgccaccgctgttgccgccgccgccccccgttcgcgcgggcgcaagagaaattatccagcggccagcgcgctcatgccccagtacgcactgcatccatccatcgcgcccacccccggctaccgcgggtactcgtaccgcccgcgcagatcagccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcattttttggaggaaaaaataaaaaaagtctagactctcacgctcgcttggtcctgtgactattttgtagaaaaaagatggaagacatcaactttgcgtcgctggccccgcgtcacggctcgcgcccgttcatgggagactggacagatatcggcaccagcaatatgagcggtggcgccttcagctggggcagtctgtggagcggccttaaaaattttggttccaccattaagaactatggcaacaaagcgtggaacagcagcacgggccagatgctgagagacaagttgaaagagcagaacttccaggagaaggtggcgcagggcctggcctctggcatcagcggggtggtggacatagctaaccaggccgtgcagaaaaagataaacagtcatctggacccccgtcctcaggtggaggaaatgcctccagcgatggagacggtgtctcccgagggcaaaggcgaaaagcgcccgcggcccgacagagaagagaccctggtgtcacacaccgaggagccgccctcttacgaggaggcagtcaaggccggcctgcccaccactcgccccatagcccccatggccaccggtgtggtgggccacaggcaacacactcccgcaacactagatctgcccccgccgtccgagccgccgcgccagccaaaggcggcgacggtgcccgctccctccacttccgccgccaacagagtgcccctgcgccgcgccgcgagcggcccccgggcctcgcgagttagcggcaactggcagagcacactgaacagcatcgtgggcctgggagtgaggagtgtgaagcgccgccgttgctactgaatgagcaagctagctaacgtgttgtatgtgtgtatgcgtcctatgtcgccgccagaggagctgttgagccgccggcgccgtctgcactccagcgaatttcaagatggcgaccccatcgatgatgcctcagtggtcgtacatgcacatctcgggccaggacgcttcggagtacctgagccccgggctggtgcagttcgcccgcgccacagacacctacttcaacatgagtaacaagttcaggaaccccactgtggcgcccacccacgatgtgaccacggaccggtcgcagcgcctgacgctgcggttcatccccgtggatcgggaggacaccgcctactcttacaaggcgcggttcacgctggccgtgggcgacaaccgcgtgctggacatggcctccacttactttgacatcaggggggtgctggacaggggccccaccttcaagccctactcgggtactgcctacaactccctggcccccaagggcgctcccaattcttgcgagtgggaacaagaggaaaatcaggtggtcgctgcagatgatgaacttgaagatgaagaagcgcaagctcaagaggacgccccagctaaaaaaattcatgtatatgcccaggcgcctcttgctggcgaaaagattaccaaggatggtttgcaaataggtactgaagttgtaggagatacatctaaggacacttttgcagacaaaacattccaacccgaacctcagataggcgagtctcagtggaacgaggctgatgccacagtagcaggaggcagagtcttgaaaaaaaccacccctatgagaccttgctatggatcctatgccaggcctacaaatgccaacgggggtcaaggaattatggttgccaatgaacaaggagtgttggagtctaaagtggagatgcaatttttttctaacactacaacccttaatgcgcgggatggagctggcaatcccgaaccaaaggtggtgttgtacagtgaagatgtccacttggaatctcctgacactcatttgtcttacaagcccaaaaaggatgatgttaatgctaaaattatgttgggtcagcaagctatggctaacaggcccaacctcattgcttttagagataatttcattggactcatgtactacaacagcactggtaacatgggagtgctggcgggtcaggcctctcagttgaatgccgtggtggacctgcaggatagaaacacagaactgtcatatcagcttatgcttgattccattggggatagatccagatacttctccatgtggaaccaggcagtggatagctatgacccagatgtcagaatcattgaaaaccatggtgtcgaggacgagctacccaactactgcttccctctgggcggcataggaattactgatacttatcaagggatcaaaaataccaatggcaatggtcagtggaccaaagatgatcagttcgcggaccgtaatgaaataggggtgggaaacaacttcgccatggagatcaacatccaggccaacctctggaggaacttcctctatgcgaacgtggggctctacctgccagacaagctcaagtacaaccccaccaacgtggacatctctgacaaccccaacacctatgactacatgaacaagcgtgtggtggctcccggcctggtggactgctttgtcaatgtgggagccaggtggtccctggactacatggacaacgtcaaccccttcaaccaccaccgcaatgcgggtctgcgctaccgctccatgatcctgggcaacgggcgctacgtgcccttccacattcaggtgccccagaagttctttgccatcaagaacctcctcctcctgccgggctcctacacttacgagtggaacttcaggaaggatgtcaacatggtcctgcagagctctctgggcaatgaccttagggtggacggggccagcatcaagtttgacagcgtcaccctctatgctaccttcttccccatggctcacaacaccgcctccacgctcgaggccatgctgaggaacgacaccaacgaccagtccttcaatgactacctctctggggccaacatgctctaccccatccccgccaaggccaccaacgtgcccatctccattccctctcgcaactgggccgccttcagaggctgggcctttacccgccttaagaccaaggaaaccccctccctgggctcgggttttgacccctactttgtctactcgggatccatcccctacctggatggcaccttctacctcaaccacacttttaagaagatatccatcatgtatgactcctccgtcagctggccgggcaatgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccattggcatcactcaccagcacaacaactcgggattcgtgggctacctggctcccaccatgcgcgaggggcaggcctaccccgccaacttcccctacccgttgataggcaagaccgcggtcgacagcgtcacccagaaaaagttcctctgcgaccgcaccctctggcgcatccccttctctagcaacttcatgtccatgggtgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacctgctacctcttcgacccctttggcttctccgatcagcgcctcagacagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcacatccggggggccacctctttctgccacttgcaacaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggctcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattacgcacgctggccagcaggctctcgtcgctgatcatgtcgctgtccagatcctccgcgttgctcagggcgaatggggtcatcttgcagacctgcctgcccaggaaaggcggcagcccgggcttgccgttgcagtcgcagcgcaggggcatcagcaggtgcccgtggcccgtctgcgcctgcgggtacagcgcgcgcatgaaggcttcgatctgcctgaaagccacctgcgtcttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtcccgtgcagacacttcaggtcgccctccgtctgggtgcagcggtgctcccacagcgcgcaaccggtgggctcccaatttttgtgggtcacccccgcgtaggcctgcaggtaggcctgcaagaagcgccccatcatggccacaaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagctccgcctgctcttcttcgtcttcgctgtctaccactatctctggggaagggcttctccgctctgcggcggtgcgcttcttttttttcttgggagcagccgtgacggagtccgccacggcgacggaggtcgagggcgtggggctgggggtgcgcggtaccagggcctcgtcgccctcggactcttcctctgactccaggcggcggcggagacgcttctttgggggcgcgcgcgtcagcggcggcggagacggggacggggacggggacgggacgccctccacagggggtggtcttcgcgcagacccgcggccgcgctcgggggtcttttcgagctggtcttggtcccgactggccattgtatcctcctcctcctaggcagagagacataaggagtctatcatgcaagtcgagaaggaggagagcttaaccaccccctctgagaccgccgatgcgcccgccgtcgccgtcgcccccgctgccgccgacgcgcccgccacaccgagcgacacccccgcggaccccccagccgacgcacccctgttcgaggaagcggccgtggagcaggacccgggctttgtctcggcagaggaggatttgcgagaggaggaggataaggagaagaagccctcagtgccaaaagatgataaagagcaagacgagcacgacgcagatgcacaccagggtgaagtcgggcggggggacggagggcatgacggcgccgactacctagacgaagggaacgacgtgctcttgaagcacctgcatcgtcagtgcgccatcgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgcctttgtggtgcccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtgccaaagatcttcgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctcaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgcggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgcctggaggagcgcaacctcaaggagctggagaagctcctgcagcgcgcgctcaaagacctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaagaccaatcccgcccgcccaaggcggagctgaccgcctgcgtcatcacccagggcgagatcctaggccaattgcaagccatccaaaaagcccgccaagattttttgctgagaaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgagaaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcaattaccaccacgccccgcaataatcccaaccccagggagtggcccgcgtccctggtgtatcaggaaattcccggccccaccaccgtactacttccgcgtgattcccaggccgaagtccaaatgactaactcaggggcgcagctcgcgggcggctgtcgtcacagggtgcggcctcctcgccagggtataactcacctggagatccgaggcagaggtattcagctcaacgacgagtcggtgagctcctcgctcggtctaagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctcgggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgaggaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgactttatagagccccagtgtaacgtgacttttaaagcccatgcacagcgttgtcatactataatcaaatgtgccaccgaacacgatgaataccttatccagtataaagataaatcacacaaagtggcacttgttgacatctggaaacccgaagaccctttggaatacaatgtgaccgttttccagggtgacctcttcaaaatttacaattacactttcccatttgaccagatgtgtgactttgtcatgtacatggaaaagcagcacaagctgtggcctccgactccccagggctgtgtggaaaatccaggctctttctgcatgatctctctctgtgtaactgtgctggcactaatactcacgcttttgtatatcagatttaaatcaaggcaaagcttcatcgatgaaaagaaaatgccttaaacgctttcacgcttgattgctaacaccgggtttttatccgcagaatgattggaatcaccctactaatcacctccctccttgcgattgcccatgggttggaacgaatcgaagcccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatctaaccttgattgatgttcaaatgctggatgcgggctactattatgggcagctgggtacaatgattaattactggagaccccacaaagattacatgctccacgtagtaaagggtccccttagcagcccacccactaccacctctactacccccactaccaccactactcccaccaccagcactgccgcccagcctcctcatagcagaacaaccacttttatcaattccaagtcccactccccccacattgccggcgggccctccgcctcagactccgagaccaccgagatctgcttctgcaaatgctctgacgcctttgctgaggatttggaagaccacgaggaagatgagcatgacttcgcagatgcatgccaggcatcagaggcagaagcgctgccggtggccctcaaacagtatgcagacccccacaccacccccaaccttcctccaccttcccagaagccaagtttcctgggggaaaatgaaactctgcctctctccatactcgctctgacatctgttgctatgttgaccgctctgctggtgcttctatgctctatatgctacctgatctgctgcagaaagaaaaaatctcacggccatgctcaccagcccctcatgcacttcccttaccctccagagctgggcgaccacaaactttaagtctgcagtaactatctgcccatcccttgtcagtcgacagcgatgagccccactaatctaacggcctctggacttacaacatcgtctcttaatgagaccaccgctcctcaagacctgtacgatggtgtctccgcgctggttaaccagtgggatcacctgggcatatggtggctcctcataggagcagtgaccctgtgcctaatcctggtctggatcatctgctgcatcaaaagcagaagacccaggcggcggcccatctacaggccctttgtcatcacacctgaagatgatgatgacaccacttccaggctgcagaggctaaagcagctactcttctcttttacagcatggtaaattgaatcatgcctcgcattttcatctacttgtctctccttccactttttctgggctcttctacattggccgctgtgtcccacatcgaggtagactgcctcacgcccttcacagtctacctgcttttcggctttgtcatctgcacctttgtctgcagcgttatcactgtagtgatctgcttcatacagtgcatcgactacgtctgcgtgcgggtggcttactttagacaccacccccagtatcgcaacagggacatagcggctctcctaagacttgtttaaaatcatggccaaattaactgtgattggtcttctgatcatctgctgcgtcctagccgcgattgggactcaagctcctaccaccaccagcgctcccagaaagagacatgtatcctgcagcttcaagcgtccctggaatataccccaatgctttactgatgaacctgaaatctctttggcttggtacttcagcgtcaccgcccttcttatcttctgcagtacggttattgcccttgccatctacccttcccttgacctgggctggaatgctgtcaactctatggaatatcccaccttcccagaaccagacctgccagacctggttgttctaaacgcgtttcctcctcctgctcccgttcaaaatcagtttcgccctccgtcccccacgcccactgaggtcagctactttaatctaacaggcggagatgactgaaaacctagacctagaaatggacggtctctgcagcgagcaacgcacactagagaggcgccggcaaaaagagctcgagcgtcttaaacaagagctccaagacgcggtggccatacaccagtgcaaaaaaggtgtcttctgtctggtaaaacaggccacgctcacctatgaaaaaacaggtgacacccaccgcctaggatacaagctgcccacacagcgccagaagttcgccctcatgataggcgaacaacccatcaccgtgacccagcactccgtggagacagaaggctgcatacacgctccctgtaggggcgctgactgcctctacaccttgatcaaaaccctctgcggtctcagagacctcatcccttttaattaatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtccctttccttacccctccctttgtgtcatccgcaggaatgcaagaaaatccagctggggtgctgtccctgcacttgtcagagccccttaccacccacaatggggccctgactctaaaaatggggggcggcctgaccctggacaaggaagggaatctcacttcccaaaacatcaccagtgtcgatccccctctcaaaaaaagcaagaacaacatcagccttcagaccgccgcacccctcgccgtcagctccggggccctaacactttttgccactccccccctagcggtcagtggtgacaaccttactgtgcagtctcaggcccctctcactttggaagactcaaaactaactctggccaccaaaggacccctaactgtgtccgaaggcaaacttgtcctagaaacagaggctcccctgcatgcaagtgacagcagcagcctgggccttagcgttacggccccacttagcattaacaatgacagcctaggactagacatgcaagcgcccattagctctcgagatggaaaactggctctaacagtggcggcccccctaactgtggtcgagggtatcaatgctttggcagtagccacaggtaagggtattgggctaaatgaaaccaacacacacctgcaggcaaaactggtcgcacccctaggctttgataccaacggcaacattaagctaagcgttgcaggaggcatgaggctaaacaataacacactgatactagatgtaaactacccatttgaggctcaaggccaactgagcctaagagtgggctcgggcccactatatgtagattctagtagtcataacctaaccattagatgccttaggggattgtatataacatcttctaacaaccaaaacggtctagaagccaacattaaactaacaagaggccttgtgtatgacggaaatgccatagcagttaatgttggcaaagggctggaatacagccctactgacacaacagaaaaacctatacagactaaaataggtctaggcatggagtatgataccgagggagccatgatgacaaaactaggctctggactaagctttgacaattcaggagccattgtagtgggaaacaaaaatgatgacaggcttactttgtggaccacaccggacccatcgcccaactgtcagatctactctgaaaaagatgctaaactaaccttggtactgactaaatgtggcagtcaggttgtaggcacagtatctattgccgctcttaaaggtagcctcgtgccaatcactagtgcaatcagtgtggttcaggtatacctaaggtttgatgaaaatggggtactaatgagtaactcttcacttaatggcgaatactggaattttagaaacggagactcaactaatggcacaccatatacaaacgcagtgggtttcatgcctaatctactggcctatcctaaaggtcaaactacaactgcaaaaagtaacattgtcagccaggtctacatgaatggggacgatactaaacccatgacatttacaatcaacttcaatggccttagtgaaacaggggatacccctgttagtaaatattccatgacattctcatggaggtggccaaatggaagctacatagggcacaattttgtaacaaactcctttaccttctcctacatcgcccaagaataaagaaagcacagagatgcttgtttttgatttcaaaattgtgtgcttttatttattttcagcttacagtatttccagtagtcattcaaataaagcttaatcaaactgcatgagaacccttccacatagcttaaattagcaccagtgcaaatggagaaaaatcaacatacctttttttatccagatatcagagaactctagtggtcagttttcccccaccctcccagctcacagaatacacagtcctttccccccggctggctttaaacaacactatctcattggtaacagacatattcttaggtgtaataatccacacggtctcttggcgggccaaacgctggtcggtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgcagcaacaaggcgcgcagcaactcctgccgccgcctctccgtacggcaggaatgcaacggcgtggtggtctcctccgtgataatccgcaccgctcgcagcatcagcatcctcgtcctccgggcacagcagcgcatcctgatctcactgagatcggcgcagtaagtgcagcacaaaaccaagatgttatttaagatcccacagtgcaaagcactgtacccaaagctcatggcgggaaggacagcccccacgtgaccatcataccagatcctcaggtaaatcaaatgacgacctctcataaacacgctggacatgtacatcacctccttgggcatgtgctgattcaccacctctcgataccacaagcatcgctgattaattaaagacccctcgagcaccatcctaaaccaggaagccagcacctgaccccccgccaggcactgcagggaccccggtgaatcgcagtggcagtgaagactccagcgctcgtagccgtgaaccatagagctggtcattatatccacattggcacaacacagacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgttcggtgtagtagttgtaatacagccactccctgagaccgtcaaggcgctccctggcgtccggatctatgacaacaccgtcctgcagcgccgccctgatgacatccaccaccgtagagtatgccaagcccagccaggaaatgcattcactttgacagcgagagataggaggagcggggagagatggaagaaccatgatagtaaagagaacttttattccaatcgatcttctaagatatcaaagtggagatctataagatgacactggtctcctccgctgagtcgatcaaaaataacagctaaaccacaaacaacacgattggtcaaatgctccacaagggcctgcagcataaaattgcctcggaactccaccgcaagcataacatcaaagccaccgcctctatcgtgatcaagaataaaaaccccacagctatccaccagacccatatagttttcatctctccatcgtgaaaaaagatttacaagctcctcctttaaatcacctccaaccaattgaaaaagttgaaccagaccgccctccaccttcattttcagcaagcgtatcatgattgcaaaaattcaggctcctcagacacctgtataagattgagaagcggaacgttaacatcgatgtttcgctcgcgtaaatcacgcctcagtgcaagcataatataatcccacaggtcggagcggatcagcgaggacacctccccgccaggaaccaactcaacggagcctatgctgattataatacgcatattcggagctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacaaccacagaaaaatgcacaatttttctctcaaacatgactgcgagccctgcaaaaaataaaaaagaaacattacacaagagtagcctgtcttacgatgggatagactactctaaccaacataagacgggccacaacatcgcccgcgtggccataaaaaaaattgtccgtgtgattaaaaagaagcacagatagctggccagtcatatccggagtcatcacgtgtgaacccgtgtagacccccgggttggacacatcggccaaagaaagaaagcggccaatgtacccaggaggaattataacactaagacgaagatacaacagaataaccccatgagggggaataacaaagttagtaggtgaataaaaacgataaacacccgaaactccctcctgcgtaggcaaaatagcaccctccccttccaaaacaacatatagcgcttccacagcagccatgacaaaagactcaaaacactcaaaagactcagtcttaccaggaaaataaaagcactctcacagcaccagcactaatcagagtgtgaagagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccgctttctcacggtacgtcacttccgcaagaaaagcaaaactacatttcccacatgtgtaaaaacgaaaccccgccccttgtaaccgcccacaacttacatcatcaaaacgtaaactcctacgtcacccgccccgcctctccccgcccacctcattatcatattggccacaatccaaaataaggtatattat

The invention claimed is:

1. An isolated or purified nucleic acid sequence with at least 76.05% identity to SEQ ID NO: 1.

2. The nucleic acid sequence of claim 1, which has at least 80% identity to SEQ ID NO: 1.

3. The nucleic acid sequence of claim 1, which has at least 85% identity to SEQ ID NO: 1.

4. The nucleic acid sequence of claim 1, which has at least 90% identity to SEQ ID NO: 1.

5. The nucleic acid sequence of claim 1, which has at least 95% identity to SEQ ID NO: 1.

6. The nucleic acid sequence of claim 1, which comprises SEQ ID NO: 1.

7. An isolated or purified nucleic acid sequence encoding an amino acid sequence with at least 97.15% identity to SEQ ID NO: 2.

8. A nucleic acid sequence of claim 7, which encodes SEQ ID NO: 2.

9. The nucleic acid sequence of claim 1, further comprising a nucleic acid sequence that encodes ubiquitin.

10. The nucleic acid sequence of claim 9, which encodes SEQ ID NO: 4.

11. The nucleic acid sequence of claim 10, which comprises SEQ ID NO: 3.

12. An isolated or purified nucleic acid sequence with at least 82.56% identity to SEQ ID NO: 5.

13. The nucleic acid sequence of claim 12, which has at least 90% identity to SEQ ID NO: 5.

14. The nucleic acid sequence of claim 12, which has at least 95% identity to SEQ ID NO: 5.

15. The nucleic acid sequence of claim 12, which comprises SEQ ID NO: 5.

16. A vector comprising the nucleic acid sequence of claim 1.

17. A vector comprising (i) a nucleic acid sequence with at least 74.5% identity to SEQ ID NO: 1 and (ii) a nucleic acid sequence with at least 82.56% identity to SEQ ID NO: 5.

18. The vector of claim 17, wherein the nucleic acid sequence (i) has at least 80% identity to SEQ ID NO: 1.

19. The vector of claim 17, wherein the nucleic acid sequence (i) has at least 85% identity to SEQ ID NO: 1.

20. The vector of claim 17, wherein the nucleic acid sequence (i) has at least 90% identity to SEQ ID NO: 1.

21. The vector of claim 17, wherein the nucleic acid sequence (i) has at least 95% identity to SEQ ID NO: 1.

22. The vector of claim 17, wherein the nucleic acid sequence (ii) has at least 85% identity to SEQ ID NO: 5.

23. The vector of claim 17, wherein the nucleic acid sequence (ii) has at least 90% identity to SEQ ID NO: 5.

24. The vector of claim 17, wherein the nucleic acid sequence (ii) has at least 95% identity to SEQ ID NO: 5.

25. The vector of claim 17, wherein the vector comprises (i) SEQ ID NO: 1 and (ii) SEQ ID NO: 5.

26. The vector of claim 17, wherein the vector is a viral vector or a plasmid.

27. The vector of claim 26, wherein the vector is a poxvirus.

28. The vector of claim 26, wherein the vector is a vaccinia virus.

29. The vector of claim 26, wherein the vector is an adeno-associated vector.

30. The vector of claim 26, wherein the vector is an adenoviral vector.

31. The vector of claim 26, wherein the adenoviral vector comprises an adenoviral genome, and wherein a gorilla adenovirus is the source of the adenoviral genome.

32. The vector of claim 31, wherein the gorilla adenovirus comprises 70% or more identity to a nucleic acid sequence selected from the group consisting of SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, and combinations thereof.

33. The vector of claim 32, wherein the gorilla adenovirus comprises 80% or more identity to a nucleic acid sequence selected from the group consisting of SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, and combinations thereof.

34. The vector of claim 33, wherein the gorilla adenovirus comprises 90% or more identity to a nucleic acid sequence selected from the group consisting of SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, and combinations thereof.

35. The vector of claim 34, wherein the gorilla adenovirus comprises 95% or more identity to a nucleic acid sequence selected from the group consisting of SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, and combinations thereof.

36. The vector of claim 35, wherein the gorilla adenovirus comprises a nucleic acid sequence selected from the group consisting of SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, and combinations thereof.

37. The vector of claim 30, wherein the adenoviral vector requires complementation of a deficiency in one or more early regions of the adenoviral genome for propagation.

38. The vector of claim 37, wherein the adenoviral vector requires complementation of a deficiency in the E1 region of the adenoviral genome for propagation.

39. The vector of claim 37, wherein the adenoviral vector requires complementation of a deficiency in the E1A region of the adenoviral genome for propagation.

40. The vector of claim 37, wherein the adenoviral vector requires complementation of a deficiency in the E1B region of the adenoviral genome for propagation.

41. The vector of claim 37, wherein the adenoviral vector requires complementation of a deficiency in the E2 region of the adenoviral genome for propagation.

42. The vector of claim 37, wherein the adenoviral vector requires complementation of a deficiency in the E4 region of the adenoviral genome for propagation.

43. The vector of claim 37, wherein the adenoviral vector requires complementation of a deficiency in the E1 region of the adenoviral genome and a deficiency in the E4 region of the adenoviral genome for propagation.

44. The vector of claim 37, wherein the adenoviral vector requires complementation of a deficiency in the E1 region of the adenoviral genome and a deficiency in the E2 region of the adenoviral genome for propagation.

45. The vector of claim 37, wherein the adenoviral vector further comprises a deletion of all or part of the E3 region of the adenoviral genome.

46. A polypeptide encoded by the nucleic acid sequence of claim 1.

47. A polypeptide with at least 98% identity to SEQ ID NO: 2.

48. A composition comprising the nucleic acid sequence of claim 1 and a pharmaceutically acceptable carrier.

49. A composition comprising the vector of claim 16 and a pharmaceutically acceptable carrier.

50. A composition comprising the polypeptide of claim 46 and a pharmaceutically acceptable carrier.

51. A method of inducing an immune response against Herpes Simplex Virus (HSV) in a mammal, which method comprises administering to the mammal the composition of claim 48, whereupon an immune response against HSV is induced in the mammal.

52. A method of treating or preventing a Herpes Simplex Virus (HSV) disease in a mammal, which method comprises administering to the mammal an effective amount of the composition of claim 49, whereupon a HSV disease is treated or prevented in the mammal.

53. A method of inducing a T cell response against Herpes Simplex Virus (HSV) in a mammal, which method comprises administering to the mammal the composition of claim 49, whereupon a T cell response against HSV is induced in the mammal.

54. The method of claim 53, wherein the T cell response is a mucosal T cell response.

55. A method of inducing an immune response against Herpes Simplex Virus (HSV) in a mammal, which method comprises administering to the mammal a first administration of a composition and at least one additional administration of the same or different composition, wherein each of the administrations comprises a vector comprising:
    (a) a nucleic acid sequence with at least 76.05% identity to SEQ ID NO: 1,
    (b) a nucleic acid sequence encoding an amino acid sequence with at least 97.15% identity to SEQ ID NO: 2, or
    (c) a nucleic acid sequence with at least 82.56% identity to SEQ ID NO: 5,
    and wherein the vector in the compositions can be the same or different, whereupon an immune response against HSV is induced in the mammal.

56. The method of claim 55, wherein the immune response is a mucosal immune response.

57. A method of treating or preventing a Herpes Simplex Virus (HSV) disease in a mammal, which method comprises administering to the mammal an effective amount of each of a first administration of a composition and at least one additional administration of the same or different composition, wherein each of the administrations comprises a vector comprising:
    (a) a nucleic acid sequence with at least 76.05% identity to SEQ ID NO: 1,
    (b) a nucleic acid sequence encoding an amino acid sequence with at least 97.15% identity to SEQ ID NO: 2, or
    (c) a nucleic acid sequence with at least 82.56% identity to SEQ ID NO: 5,
    and wherein the vector in the administrations of compositions can be the same or different, whereupon a HSV disease is treated or prevented in the mammal.

58. A method of inducing a T cell response against Herpes Simplex Virus (HSV) in a mammal, which method comprises administering to the mammal a first administration of a composition and at least one additional administration of the same or different composition, wherein each of the administrations comprises a vector comprising:
    (a) a nucleic acid sequence with at least 76.05% identity to SEQ ID NO: 1,
    (b) a nucleic acid sequence encoding an amino acid sequence with at least 97.15% identity to SEQ ID NO: 2, or
    (c) a nucleic acid sequence with at least 82.56% identity to SEQ ID NO: 5,
    and wherein the vector in the administrations of compositions can be the same or different, whereupon a T cell response against HSV is induced in the mammal.

59. The method of claim 58, wherein the T cell response is a mucosal T cell response.

60. A method of inducing an antibody response against Herpes Simplex Virus (HSV) in a mammal, which method comprises administering to the mammal a first administration of a composition and at least one additional administration of the same or different composition, wherein each of the administrations comprises the vector of claim 16, and wherein the vector in the administrations of compositions can be the same or different, whereupon an antibody response against HSV is induced in the mammal.

61. A method of treating or preventing a Herpes Simplex Virus (HSV) disease in a mammal, which method comprises administering to the mammal an effective amount of (a) and (b):
    (a) a first composition comprising the vector of claim 31, and
    (b) a second composition comprising the vector of claim 31, wherein (i) the second composition is administered after the first composition, and (ii) the vector in the compositions are the same or different, whereupon the T cell response induced after administration of the first and second compositions is greater than the T cell response induced after administration of the first composition alone or the second composition alone, and a HSV disease is treated or prevented in the mammal.

62. The method of claim 51, which further comprises administering one or more cytokines or adjuvants to the mammal.

63. The method of claim 51, wherein the HSV is HSV-1.

64. The method of claim 51, wherein the HSV is HSV-2.

65. The method of claim 51, wherein the administration is intramuscular administration, intradermal administration, or subcutaneous administration.

66. A vector comprising the nucleic acid sequence of claim 8.

67. A polypeptide encoded by the nucleic acid sequence of claim 8.

68. A composition comprising the nucleic acid sequence of claim 8 and a pharmaceutically acceptable carrier.

69. A composition comprising the vector of claim 66 and a pharmaceutically acceptable carrier.

70. A composition comprising the polypeptide of claim 47 and a pharmaceutically acceptable carrier.

* * * * *